United States Patent 12,049,623 (COMPOSITIONS AND METHODS FOR IDENTIFYING POLYNUCLEOTIDES OF INTEREST) - sequence listing, part 3

SEQ ID NO: 63012 - DNA, 18 bp, synthetic construct
  source 1..18: mol_type = other DNA
tagtatccatctctatag

SEQ ID NO: 63013 - DNA, 18 bp, synthetic construct
  source 1..18: mol_type = other DNA
tagtatgactcaaaaaag

SEQ ID NO: 63014 - DNA, 18 bp, synthetic construct
  source 1..18: mol_type = other DNA
tagtatgtctctgtttag

SEQ ID NO: 63015 - DNA, 18 bp, synthetic construct
  source 1..18: mol_type = other DNA
tagtatgtctctttaaag

SEQ ID NO: 63016 - DNA, 18 bp, synthetic construct
  source 1..18: mol_type = other DNA
tagtgcgattcacattag

SEQ ID NO: 63017 - DNA, 18 bp, synthetic construct
  source 1..18: mol_type = other DNA
tagttagactcaaatagg

SEQ ID NO: 63018 - DNA, 18 bp, synthetic construct
  source 1..18: mol_type = other DNA
tagttaggcgcagtatag

SEQ ID NO: 63019 - DNA, 18 bp, synthetic construct
  source 1..18: mol_type = other DNA
tagttcaacatactatag

SEQ ID NO: 63020 - DNA, 18 bp, synthetic construct
  source 1..18: mol_type = other DNA
tagttcaactcacttcag

SEQ ID NO: 63021 - DNA, 18 bp, synthetic construct
  source 1..18: mol_type = other DNA
tagttcattttattaagg

SEQ ID NO: 63022 - DNA, 18 bp, synthetic construct
  source 1..18: mol_type = other DNA
tagttccttacaataacg

SEQ ID NO: 63023 - DNA, 18 bp, synthetic construct
  source 1..18: mol_type = other DNA
tagttcgactcacttgcg

SEQ ID NO: 63024 - DNA, 18 bp, synthetic construct
  source 1..18: mol_type = other DNA
tagttcgactctatattg

SEQ ID NO: 63025 - DNA, 18 bp, synthetic construct
  source 1..18: mol_type = other DNA
tagttcgactctctgaag

SEQ ID NO: 63026 - DNA, 18 bp, synthetic construct
  source 1..18: mol_type = other DNA
tagttcgagacacaaaag

SEQ ID NO: 63027 - DNA, 18 bp, synthetic construct
  source 1..18: mol_type = other DNA
tagttcgtcttaatattg

SEQ ID NO: 63028 - DNA, 18 bp, synthetic construct
  source 1..18: mol_type = other DNA
tagttctactcacttcag

SEQ ID NO: 63029 - DNA, 18 bp, synthetic construct
  source 1..18: mol_type = other DNA
tagttggtctcactacag

SEQ ID NO: 63030 - DNA, 18 bp, synthetic construct
  source 1..18: mol_type = other DNA
tagtttaattcattattg

SEQ ID NO: 63031 - DNA, 18 bp, synthetic construct
  source 1..18: mol_type = other DNA
tagtttgtcttgctatgg

SEQ ID NO: 63032 - DNA, 18 bp, synthetic construct
  source 1..18: mol_type = other DNA
tataaagaatccctaaag

SEQ ID NO: 63033 - DNA, 18 bp, synthetic construct
  source 1..18: mol_type = other DNA
tataaaggatcactatag

SEQ ID NO: 63034 - DNA, 18 bp, synthetic construct
  source 1..18: mol_type = other DNA
tataacaactcacttttg

SEQ ID NO: 63035 - DNA, 18 bp, synthetic construct
  source 1..18: mol_type = other DNA
tataacatatcactaaag

SEQ ID NO: 63036 - DNA, 18 bp, synthetic construct
  source 1..18: mol_type = other DNA
tataacatttcactatcg

SEQ ID NO: 63037 - DNA, 18 bp, synthetic construct
  source 1..18: mol_type = other DNA
tataacccctcacaatag

SEQ ID NO: 63038 - DNA, 18 bp, synthetic construct
  source 1..18: mol_type = other DNA
tataacctctcacttaag

SEQ ID NO: 63039 - DNA, 18 bp, synthetic construct
  source 1..18: mol_type = other DNA
tataacgactatcaattg

SEQ ID NO: 63040 - DNA, 18 bp, synthetic construct
  source 1..18: mol_type = other DNA
tataacgactcccttttg

SEQ ID NO: 63041 - DNA, 18 bp, synthetic construct
  source 1..18: mol_type = other DNA
tataacgacttactaatg

SEQ ID NO: 63042 - DNA, 18 bp, synthetic construct
  source 1..18: mol_type = other DNA
tataacgacttttcatag

SEQ ID NO: 63043 - DNA, 18 bp, synthetic construct
  source 1..18: mol_type = other DNA
tataacgagcttctatag

SEQ ID NO: 63044 - DNA, 18 bp, synthetic construct
  source 1..18: mol_type = other DNA
tataacgagtttctattg

SEQ ID NO: 63045 - DNA, 18 bp, synthetic construct
  source 1..18: mol_type = other DNA
tataacgcatcacataag

SEQ ID NO: 63046 - DNA, 18 bp, synthetic construct
  source 1..18: mol_type = other DNA
tataacgccccacgaaag

SEQ ID NO: 63047 - DNA, 18 bp, synthetic construct
  source 1..18: mol_type = other DNA
tataacgctactttatag

SEQ ID NO: 63048 - DNA, 18 bp, synthetic construct
  source 1..18: mol_type = other DNA
tataacgtcactctctag

SEQ ID NO: 63049 - DNA, 18 bp, synthetic construct
  source 1..18: mol_type = other DNA
tataacgtctacctatag

SEQ ID NO: 63050 - DNA, 18 bp, synthetic construct
  source 1..18: mol_type = other DNA
tataacgtctagctacag

SEQ ID NO: 63051 - DNA, 18 bp, synthetic construct
  source 1..18: mol_type = other DNA
tataacgtttcacaacag

SEQ ID NO: 63052 - DNA, 18 bp, synthetic construct
  source 1..18: mol_type = other DNA
tataactactcataatag

SEQ ID NO: 63053 - DNA, 18 bp, synthetic construct
  source 1..18: mol_type = other DNA
tataaggactcattaaag

SEQ ID NO: 63054 - DNA, 18 bp, synthetic construct
  source 1..18: mol_type = other DNA
tataaggattcaatatag

SEQ ID NO: 63055 - DNA, 18 bp, synthetic construct
  source 1..18: mol_type = other DNA
tataaggattcactacag

SEQ ID NO: 63056 - DNA, 18 bp, synthetic construct
  source 1..18: mol_type = other DNA
tataaggtaaagctatag

SEQ ID NO: 63057 - DNA, 18 bp, synthetic construct
  source 1..18: mol_type = other DNA
tataaggtctcataaaag

SEQ ID NO: 63058 - DNA, 18 bp, synthetic construct
  source 1..18: mol_type = other DNA
tataatgaaacactatag

SEQ ID NO: 63059 - DNA, 18 bp, synthetic construct
  source 1..18: mol_type = other DNA
tataatgacacacacttg

SEQ ID NO: 63060 - DNA, 18 bp, synthetic construct
  source 1..18: mol_type = other DNA
tataatgacgcactttgg

SEQ ID NO: 63061 - DNA, 18 bp, synthetic construct
  source 1..18: mol_type = other DNA
tataatgacgccttatag

SEQ ID NO: 63062 - DNA, 18 bp, synthetic construct
  source 1..18: mol_type = other DNA
tataatgacttaatttag

SEQ ID NO: 63063 - DNA, 18 bp, synthetic construct
  source 1..18: mol_type = other DNA
tataatgatttacaattg

SEQ ID NO: 63064 - DNA, 18 bp, synthetic construct
  source 1..18: mol_type = other DNA
tataatgtctcactttag

SEQ ID NO: 63065 - DNA, 18 bp, synthetic construct
  source 1..18: mol_type = other DNA
tataattactccctattg

SEQ ID NO: 63066 - DNA, 18 bp, synthetic construct
  source 1..18: mol_type = other DNA
tatacagtatcactacag

SEQ ID NO: 63067 - DNA, 18 bp, synthetic construct
  source 1..18: mol_type = other DNA
tataccgactaactatgg

SEQ ID NO: 63068 - DNA, 18 bp, synthetic construct
  source 1..18: mol_type = other DNA
tataccgacttactaatg

SEQ ID NO: 63069 - DNA, 18 bp, synthetic construct
  source 1..18: mol_type = other DNA
tataccgatttacaaaag

SEQ ID NO: 63070 - DNA, 18 bp, synthetic construct
  source 1..18: mol_type = other DNA
tatagaaacacacgatag

SEQ ID NO: 63071 - DNA, 18 bp, synthetic construct
  source 1..18: mol_type = other DNA
tatatagactcataatag

SEQ ID NO: 63072 - DNA, 18 bp, synthetic construct
  source 1..18: mol_type = other DNA
tatatcgacactcaatag

SEQ ID NO: 63073 - DNA, 18 bp, synthetic construct
  source 1..18: mol_type = other DNA
tatatcgactaaatatag

SEQ ID NO: 63074 - DNA, 18 bp, synthetic construct
  source 1..18: mol_type = other DNA
tatatcgattcacaatag

SEQ ID NO: 63075 - DNA, 18 bp, synthetic construct
  source 1..18: mol_type = other DNA
tatatctactcatcatag

SEQ ID NO: 63076 - DNA, 18 bp, synthetic construct
  source 1..18: mol_type = other DNA
tatatcttcttactatag

SEQ ID NO: 63077 - DNA, 18 bp, synthetic construct
  source 1..18: mol_type = other DNA
tatatggaatctcactaa

SEQ ID NO: 63078 - DNA, 18 bp, synthetic construct
  source 1..18: mol_type = other DNA
tatcaccaataactattg

SEQ ID NO: 63079 - DNA, 18 bp, synthetic construct
  source 1..18: mol_type = other DNA
tatcacgaatcataatag

SEQ ID NO: 63080 - DNA, 18 bp, synthetic construct
  source 1..18: mol_type = other DNA
tatcacgacattctatag

SEQ ID NO: 63081 - DNA, 18 bp, synthetic construct
  source 1..18: mol_type = other DNA
tatcacgatacacttaag

SEQ ID NO: 63082 - DNA, 18 bp, synthetic construct
  source 1..18: mol_type = other DNA
tatcacgattgatactag

SEQ ID NO: 63083 - DNA, 18 bp, synthetic construct
  source 1..18: mol_type = other DNA
tatcacgtccatcttttg

SEQ ID NO: 63084 - DNA, 18 bp, synthetic construct
  source 1..18: mol_type = other DNA
tatcacgtctacacatag

SEQ ID NO: 63085 - DNA, 18 bp, synthetic construct
  source 1..18: mol_type = other DNA
tatcacttcaaacttttg

SEQ ID NO: 63086 - DNA, 18 bp, synthetic construct
  source 1..18: mol_type = other DNA
tatcaggactctcactag

SEQ ID NO: 63087 - DNA, 18 bp, synthetic construct
  source 1..18: mol_type = other DNA
tatcatgacacaatattg

SEQ ID NO: 63088 - DNA, 18 bp, synthetic construct
  source 1..18: mol_type = other DNA
tatcatggcacactatag

SEQ ID NO: 63089 - DNA, 18 bp, synthetic construct
  source 1..18: mol_type = other DNA
tatcatggctcatgatag

SEQ ID NO: 63090 - DNA, 18 bp, synthetic construct
  source 1..18: mol_type = other DNA
tatcatgtcccacaatag

SEQ ID NO: 63091 - DNA, 18 bp, synthetic construct
  source 1..18: mol_type = other DNA
tatcccgactctctcgag

SEQ ID NO: 63092 - DNA, 18 bp, synthetic construct
  source 1..18: mol_type = other DNA
tatcctgacttcctatgg

SEQ ID NO: 63093 - DNA, 18 bp, synthetic construct
  source 1..18: mol_type = other DNA
tatctaaactcgcaacag

SEQ ID NO: 63094 - DNA, 18 bp, synthetic construct
  source 1..18: mol_type = other DNA
tatctcaactctctatcg

SEQ ID NO: 63095 - DNA, 18 bp, synthetic construct
  source 1..18: mol_type = other DNA
tatctcgaatcattatag

SEQ ID NO: 63096 - DNA, 18 bp, synthetic construct
  source 1..18: mol_type = other DNA
tatctcgactcacaaaag

SEQ ID NO: 63097 - DNA, 18 bp, synthetic construct
  source 1..18: mol_type = other DNA
tatctcgtctcacgtcag

SEQ ID NO: 63098 - DNA, 18 bp, synthetic construct
  source 1..18: mol_type = other DNA
tatctcgtttcactatag

SEQ ID NO: 63099 - DNA, 18 bp, synthetic construct
  source 1..18: mol_type = other DNA
tatgacagaaaactaaag

SEQ ID NO: 63100 - DNA, 18 bp, synthetic construct
  source 1..18: mol_type = other DNA
tatgactactcgccatag

SEQ ID NO: 63101 - DNA, 18 bp, synthetic construct
  source 1..18: mol_type = other DNA
tatggcttcacggttgag

SEQ ID NO: 63102 - DNA, 18 bp, synthetic construct
  source 1..18: mol_type = other DNA
tattaaaaatcattatag

SEQ ID NO: 63103 - DNA, 18 bp, synthetic construct
  source 1..18: mol_type = other DNA
tattaaaacttacttaag

SEQ ID NO: 63104 - DNA, 18 bp, synthetic construct
  source 1..18: mol_type = other DNA
tattaagacacacaacag

SEQ ID NO: 63105 - DNA, 18 bp, synthetic construct
  source 1..18: mol_type = other DNA
tattaagactcataacag

SEQ ID NO: 63106 - DNA, 18 bp, synthetic construct
  source 1..18: mol_type = other DNA
tattaagactctttgatg

SEQ ID NO: 63107 - DNA, 18 bp, synthetic construct
  source 1..18: mol_type = other DNA
tattaagacttataattg

SEQ ID NO: 63108 - DNA, 18 bp, synthetic construct
  source 1..18: mol_type = other DNA
tattaagattaaccttag

SEQ ID NO: 63109 - DNA, 18 bp, synthetic construct
  source 1..18: mol_type = other DNA
tattaagattcccaatag

SEQ ID NO: 63110 - DNA, 18 bp, synthetic construct
  source 1..18: mol_type = other DNA
tattaagattcgcttagg

SEQ ID NO: 63111 - DNA, 18 bp, synthetic construct
  source 1..18: mol_type = other DNA
tattaagattctctattg

SEQ ID NO: 63112 - DNA, 18 bp, synthetic construct
  source 1..18: mol_type = other DNA
tattaagcatcattaatg

SEQ ID NO: 63113 - DNA, 18 bp, synthetic construct
  source 1..18: mol_type = other DNA
tattaagtcacactaaag

SEQ ID NO: 63114 - DNA, 18 bp, synthetic construct
  source 1..18: mol_type = other DNA
tattaagtctcacttttg

SEQ ID NO: 63115 - DNA, 18 bp, synthetic construct
  source 1..18: mol_type = other DNA
tattaatatatcggacag

SEQ ID NO: 63116 - DNA, 18 bp, synthetic construct
  source 1..18: mol_type = other DNA
tattacaaaactatatag

SEQ ID NO: 63117 - DNA, 18 bp, synthetic construct
  source 1..18: mol_type = other DNA
tattacaacatcctaaag

SEQ ID NO: 63118 - DNA, 18 bp, synthetic construct
  source 1..18: mol_type = other DNA
tattacaacgaactaaag

SEQ ID NO: 63119 - DNA, 18 bp, synthetic construct
  source 1..18: mol_type = other DNA
tattacaactcacttaaa

SEQ ID NO: 63120 - DNA, 18 bp, synthetic construct
  source 1..18: mol_type = other DNA
tattacaactcgctaatg

SEQ ID NO: 63121 - DNA, 18 bp, synthetic construct
  source 1..18: mol_type = other DNA
tattacaactctctgaag

SEQ ID NO: 63122 - DNA, 18 bp, synthetic construct
  source 1..18: mol_type = other DNA
tattacaacttgcaatag

SEQ ID NO: 63123 - DNA, 18 bp, synthetic construct
  source 1..18: mol_type = other DNA
tattacaccacactattg

SEQ ID NO: 63124 - DNA, 18 bp, synthetic construct
  source 1..18: mol_type = other DNA
tattacatattactattg

SEQ ID NO: 63125 - DNA, 18 bp, synthetic construct
  source 1..18: mol_type = other DNA
tattacatcgcacaatag

SEQ ID NO: 63126 - DNA, 18 bp, synthetic construct
  source 1..18: mol_type = other DNA
tattacatctctctttcg

SEQ ID NO: 63127 - DNA, 18 bp, synthetic construct
  source 1..18: mol_type = other DNA
tattacattaacttatag

SEQ ID NO: 63128 - DNA, 18 bp, synthetic construct
  source 1..18: mol_type = other DNA
tattaccactctctttgg

SEQ ID NO: 63129 - DNA, 18 bp, synthetic construct
  source 1..18: mol_type = other DNA
tattaccattcagtttcg

SEQ ID NO: 63130 - DNA, 18 bp, synthetic construct
  source 1..18: mol_type = other DNA
tattacctatcactttag

SEQ ID NO: 63131 - DNA, 18 bp, synthetic construct
  source 1..18: mol_type = other DNA
tattacctcacagttcag

SEQ ID NO: 63132 - DNA, 18 bp, synthetic construct
  source 1..18: mol_type = other DNA
tattacctctcacttaag

SEQ ID NO: 63133 - DNA, 18 bp, synthetic construct
  source 1..18: mol_type = other DNA
tattacgaataacaatgg

SEQ ID NO: 63134 - DNA, 18 bp, synthetic construct
  source 1..18: mol_type = other DNA
tattacgaatcgatatcg

SEQ ID NO: 63135 - DNA, 18 bp, synthetic construct
  source 1..18: mol_type = other DNA
tattacgaatctcttcag

SEQ ID NO: 63136 - DNA, 18 bp, synthetic construct
  source 1..18: mol_type = other DNA
tattacgaatggcaatag

SEQ ID NO: 63137 - DNA, 18 bp, synthetic construct
  source 1..18: mol_type = other DNA
tattacgacacatgttag

SEQ ID NO: 63138 - DNA, 18 bp, synthetic construct
  source 1..18: mol_type = other DNA
tattacgacactcgttag

SEQ ID NO: 63139 - DNA, 18 bp, synthetic construct
  source 1..18: mol_type = other DNA
tattacgacacttactag

SEQ ID NO: 63140 - DNA, 18 bp, synthetic construct
  source 1..18: mol_type = other DNA
tattacgacagacttttg

SEQ ID NO: 63141 - DNA, 18 bp, synthetic construct
  source 1..18: mol_type = other DNA
tattacgacatccaaatg

SEQ ID NO: 63142 - DNA, 18 bp, synthetic construct
  source 1..18: mol_type = other DNA
tattacgaccatcaatag

SEQ ID NO: 63143 - DNA, 18 bp, synthetic construct
  source 1..18: mol_type = other DNA
tattacgacctacttaag

SEQ ID NO: 63144 - DNA, 18 bp, synthetic construct
  source 1..18: mol_type = other DNA
tattacgactaattaacg

SEQ ID NO: 63145 - DNA, 18 bp, synthetic construct
  source 1..18: mol_type = other DNA
tattacgactaattaatg

SEQ ID NO: 63146 - DNA, 18 bp, synthetic construct
  source 1..18: mol_type = other DNA
tattacgactcacatatg

SEQ ID NO: 63147 - DNA, 18 bp, synthetic construct
  source 1..18: mol_type = other DNA
tattacgactcgcatttg

SEQ ID NO: 63148 - DNA, 18 bp, synthetic construct
  source 1..18: mol_type = other DNA
tattacgactggtaatgg

SEQ ID NO: 63149 - DNA, 18 bp, synthetic construct
  source 1..18: mol_type = other DNA
tattacgagacacctaag

SEQ ID NO: 63150 - DNA, 18 bp, synthetic construct
  source 1..18: mol_type = other DNA
tattacgagtcataaatg

SEQ ID NO: 63151 - DNA, 18 bp, synthetic construct
  source 1..18: mol_type = other DNA
tattacgagttacaaaag

SEQ ID NO: 63152 - DNA, 18 bp, synthetic construct
  source 1..18: mol_type = other DNA
tattacgatatcctttag

SEQ ID NO: 63153 - DNA, 18 bp, synthetic construct
  source 1..18: mol_type = other DNA
tattacgatccaacatag

SEQ ID NO: 63154 - DNA, 18 bp, synthetic construct
  source 1..18: mol_type = other DNA
tattacgatcctctaaag

SEQ ID NO: 63155 - DNA, 18 bp, synthetic construct
  source 1..18: mol_type = other DNA
tattacgatttacactcg

SEQ ID NO: 63156 - DNA, 18 bp, synthetic construct
  source 1..18: mol_type = other DNA
tattacgcctcctaaaag

SEQ ID NO: 63157 - DNA, 18 bp, synthetic construct
  source 1..18: mol_type = other DNA
tattacggcaatctatag

SEQ ID NO: 63158 - DNA, 18 bp, synthetic construct
  source 1..18: mol_type = other DNA
tattacggcactccatag

SEQ ID NO: 63159 - DNA, 18 bp, synthetic construct
  source 1..18: mol_type = other DNA
tattacggctaacgaatg

SEQ ID NO: 63160 - DNA, 18 bp, synthetic construct
  source 1..18: mol_type = other DNA
tattacgtagctctattg

SEQ ID NO: 63161 - DNA, 18 bp, synthetic construct
  source 1..18: mol_type = other DNA
tattacgtatcgctgtag

SEQ ID NO: 63162 - DNA, 18 bp, synthetic construct
  source 1..18: mol_type = other DNA
tattacgtcacacaatgg

SEQ ID NO: 63163 - DNA, 18 bp, synthetic construct
  source 1..18: mol_type = other DNA
tattacgtcacagtacag

SEQ ID NO: 63164 - DNA, 18 bp, synthetic construct
  source 1..18: mol_type = other DNA
tattacgtcacattctag

SEQ ID NO: 63165 - DNA, 18 bp, synthetic construct
  source 1..18: mol_type = other DNA
tattacgtcaccctgaag

SEQ ID NO: 63166 - DNA, 18 bp, synthetic construct
  source 1..18: mol_type = other DNA
tattacgtcagacaatgg

SEQ ID NO: 63167 - DNA, 18 bp, synthetic construct
  source 1..18: mol_type = other DNA
tattacgtctcaatactg

SEQ ID NO: 63168 - DNA, 18 bp, synthetic construct
  source 1..18: mol_type = other DNA
tattacgtctcgcatagg

SEQ ID NO: 63169 - DNA, 18 bp, synthetic construct
  source 1..18: mol_type = other DNA
tattacgttccactttag

SEQ ID NO: 63170 - DNA, 18 bp, synthetic construct
  source 1..18: mol_type = other DNA
tattacgtttgaatatag

SEQ ID NO: 63171 - DNA, 18 bp, synthetic construct
  source 1..18: mol_type = other DNA
tattacgtttgacttttg

SEQ ID NO: 63172 - DNA, 18 bp, synthetic construct
  source 1..18: mol_type = other DNA
tattactaatcattaagg

SEQ ID NO: 63173 - DNA, 18 bp, synthetic construct
  source 1..18: mol_type = other DNA
tattactaatctacttag

SEQ ID NO: 63174 - DNA, 18 bp, synthetic construct
  source 1..18: mol_type = other DNA
tattactacacacttcag

SEQ ID NO: 63175 - DNA, 18 bp, synthetic construct
  source 1..18: mol_type = other DNA
tattactacacattttag

SEQ ID NO: 63176 - DNA, 18 bp, synthetic construct
  source 1..18: mol_type = other DNA
tattactacattctatag

SEQ ID NO: 63177 - DNA, 18 bp, synthetic construct
  source 1..18: mol_type = other DNA
tattactactccccattg

SEQ ID NO: 63178 - DNA, 18 bp, synthetic construct
  source 1..18: mol_type = other DNA
tattactactcctttcag

SEQ ID NO: 63179 - DNA, 18 bp, synthetic construct
  source 1..18: mol_type = other DNA
tattactactcgcttaag

SEQ ID NO: 63180 - DNA, 18 bp, synthetic construct
  source 1..18: mol_type = other DNA
tattactatacacttaag

SEQ ID NO: 63181 - DNA, 18 bp, synthetic construct
  source 1..18: mol_type = other DNA
tattactatcaaaaatag

SEQ ID NO: 63182 - DNA, 18 bp, synthetic construct
  source 1..18: mol_type = other DNA
tattactcccctctgttg

SEQ ID NO: 63183 - DNA, 18 bp, synthetic construct
  source 1..18: mol_type = other DNA
tattactcctcattttag

SEQ ID NO: 63184 - DNA, 18 bp, synthetic construct
  source 1..18: mol_type = other DNA
tattactcgtctctttag

SEQ ID NO: 63185 - DNA, 18 bp, synthetic construct
  source 1..18: mol_type = other DNA
tattacttcctattatag

SEQ ID NO: 63186 - DNA, 18 bp, synthetic construct
  source 1..18: mol_type = other DNA
tattactttttactttag

SEQ ID NO: 63187 - DNA, 18 bp, synthetic construct
  source 1..18: mol_type = other DNA
tattagatcagattgaag

SEQ ID NO: 63188 - DNA, 18 bp, synthetic construct
  source 1..18: mol_type = other DNA
tattaggacgaacaatcg

SEQ ID NO: 63189 - DNA, 18 bp, synthetic construct
  source 1..18: mol_type = other DNA
tattaggactagctaaag

SEQ ID NO: 63190 - DNA, 18 bp, synthetic construct
  source 1..18: mol_type = other DNA
tattataagtcactaaag

SEQ ID NO: 63191 - DNA, 18 bp, synthetic construct
  source 1..18: mol_type = other DNA
tattatcactcaaaatag

SEQ ID NO: 63192 - DNA, 18 bp, synthetic construct
  source 1..18: mol_type = other DNA
tattatcactcaatattg

SEQ ID NO: 63193 - DNA, 18 bp, synthetic construct
  source 1..18: mol_type = other DNA
tattatgaatcacctaag

SEQ ID NO: 63194 - DNA, 18 bp, synthetic construct
  source 1..18: mol_type = other DNA
tattatgacacataaaag

SEQ ID NO: 63195 - DNA, 18 bp, synthetic construct
  source 1..18: mol_type = other DNA
tattatgatttaccatcg

SEQ ID NO: 63196 - DNA, 18 bp, synthetic construct
  source 1..18: mol_type = other DNA
tattatgtctaaccgtaa

SEQ ID NO: 63197 - DNA, 18 bp, synthetic construct
  source 1..18: mol_type = other DNA
tattatgtttcactacag

SEQ ID NO: 63198 - DNA, 18 bp, synthetic construct
  source 1..18: mol_type = other DNA
tattattactaagtacag

SEQ ID NO: 63199 - DNA, 18 bp, synthetic construct
  source 1..18: mol_type = other DNA
tattattactgaatatag

SEQ ID NO: 63200 - DNA, 18 bp, synthetic construct
  source 1..18: mol_type = other DNA
tattcagactctcataag

SEQ ID NO: 63201 - DNA, 18 bp, synthetic construct
  source 1..18: mol_type = other DNA
tattccatgtcactatgg

SEQ ID NO: 63202 - DNA, 18 bp, synthetic construct
  source 1..18: mol_type = other DNA
tattccgcaactctattg

SEQ ID NO: 63203 - DNA, 18 bp, synthetic construct
  source 1..18: mol_type = other DNA
tattccgtctcaaaaaag

SEQ ID NO: 63204 - DNA, 18 bp, synthetic construct
  source 1..18: mol_type = other DNA
tattcctactcattttag

SEQ ID NO: 63205 - DNA, 18 bp, synthetic construct
  source 1..18: mol_type = other DNA
tattcggacttactttag

SEQ ID NO: 63206 - DNA, 18 bp, synthetic construct
  source 1..18: mol_type = other DNA
tattctatcccacaatag

SEQ ID NO: 63207 - DNA, 18 bp, synthetic construct
  source 1..18: mol_type = other DNA
tattgcaacccacttttg

SEQ ID NO: 63208 - DNA, 18 bp, synthetic construct
  source 1..18: mol_type = other DNA
tattgcaattcacaatag

SEQ ID NO: 63209 - DNA, 18 bp, synthetic construct
  source 1..18: mol_type = other DNA
tattgcacttcagtatag

SEQ ID NO: 63210 - DNA, 18 bp, synthetic construct
  source 1..18: mol_type = other DNA
tattgcagctcactttag

SEQ ID NO: 63211 - DNA, 18 bp, synthetic construct
  source 1..18: mol_type = other DNA
tattgcgactgattgttg

SEQ ID NO: 63212 - DNA, 18 bp, synthetic construct
  source 1..18: mol_type = other DNA
tattgcgtatggctatag

SEQ ID NO: 63213 - DNA, 18 bp, synthetic construct
  source 1..18: mol_type = other DNA
tattgcgtctcacaatgg

SEQ ID NO: 63214 - DNA, 18 bp, synthetic construct
  source 1..18: mol_type = other DNA
tattgcgtctctatatag

SEQ ID NO: 63215 - DNA, 18 bp, synthetic construct
  source 1..18: mol_type = other DNA
tattgcgtttcattatag

SEQ ID NO: 63216 - DNA, 18 bp, synthetic construct
  source 1..18: mol_type = other DNA
tattgtaaatctctatag

SEQ ID NO: 63217 - DNA, 18 bp, synthetic construct
  source 1..18: mol_type = other DNA
tattgtgactcactaatg

SEQ ID NO: 63218 - DNA, 18 bp, synthetic construct
  source 1..18: mol_type = other DNA
tattgtgtttcactatag

SEQ ID NO: 63219 - DNA, 18 bp, synthetic construct
  source 1..18: mol_type = other DNA
tatttagtttcactattg

SEQ ID NO: 63220 - DNA, 18 bp, synthetic construct
  source 1..18: mol_type = other DNA
tatttcaacacactattg

SEQ ID NO: 63221 - DNA, 18 bp, synthetic construct
  source 1..18: mol_type = other DNA
tatttcaacccattatag

SEQ ID NO: 63222 - DNA, 18 bp, synthetic construct
  source 1..18: mol_type = other DNA
tatttcaactctctattg

SEQ ID NO: 63223 - DNA, 18 bp, synthetic construct
  source 1..18: mol_type = other DNA
tatttcaattcacttttg

SEQ ID NO: 63224 - DNA, 18 bp, synthetic construct
  source 1..18: mol_type = other DNA
tatttcatctcatttcag

SEQ ID NO: 63225 - DNA, 18 bp, synthetic construct
  source 1..18: mol_type = other DNA
tatttccaatcactttag

SEQ ID NO: 63226 - DNA, 18 bp, synthetic construct
  source 1..18: mol_type = other DNA
tatttccactcaacatag

SEQ ID NO: 63227 - DNA, 18 bp, synthetic construct
  source 1..18: mol_type = other DNA
tatttcgaaactttattg

SEQ ID NO: 63228 - DNA, 18 bp, synthetic construct
  source 1..18: mol_type = other DNA
tatttcgacacaccattg

SEQ ID NO: 63229 - DNA, 18 bp, synthetic construct
  source 1..18: mol_type = other DNA
tatttcgtatccttatag

SEQ ID NO: 63230 - DNA, 18 bp, synthetic construct
  source 1..18: mol_type = other DNA
tatttctactcaatgtag

SEQ ID NO: 63231 - DNA, 18 bp, synthetic construct
  source 1..18: mol_type = other DNA
tatttcttctcaccatag

SEQ ID NO: 63232 - DNA, 18 bp, synthetic construct
  source 1..18: mol_type = other DNA
tatttgtacttactatag

SEQ ID NO: 63233 - DNA, 18 bp, synthetic construct
  source 1..18: mol_type = other DNA
tattttaactcactttag

SEQ ID NO: 63234 - DNA, 18 bp, synthetic construct
  source 1..18: mol_type = other DNA
tattttcgctcatattag

SEQ ID NO: 63235 - DNA, 18 bp, synthetic construct
  source 1..18: mol_type = other DNA
tattttgacacacaacag

SEQ ID NO: 63236 - DNA, 18 bp, synthetic construct
  source 1..18: mol_type = other DNA
tattttgcctccctatag

SEQ ID NO: 63237 - DNA, 18 bp, synthetic construct
  source 1..18: mol_type = other DNA
tatttttactcatttttg

SEQ ID NO: 63238 - DNA, 18 bp, synthetic construct
  source 1..18: mol_type = other DNA
tatttttactcgccaaag

SEQ ID NO: 63239 - DNA, 18 bp, synthetic construct
  source 1..18: mol_type = other DNA
tcaaaacacaaactctag

SEQ ID NO: 63240 - DNA, 18 bp, synthetic construct
  source 1..18: mol_type = other DNA
tcaaacaaaatactatag

SEQ ID NO: 63241 - DNA, 18 bp, synthetic construct
  source 1..18: mol_type = other DNA
tcaaacgacacaatttag

SEQ ID NO: 63242 - DNA, 18 bp, synthetic construct
  source 1..18: mol_type = other DNA
tcaaacgactaaacatag

SEQ ID NO: 63243 - DNA, 18 bp, synthetic construct
  source 1..18: mol_type = other DNA
tcaaacgcctcgtcattg

SEQ ID NO: 63244 - DNA, 18 bp, synthetic construct
  source 1..18: mol_type = other DNA
tcaaacgtcactccaagg

SEQ ID NO: 63245 - DNA, 18 bp, synthetic construct
  source 1..18: mol_type = other DNA
tcaaacgtcgcactattg

SEQ ID NO: 63246 - DNA, 18 bp, synthetic construct
  source 1..18: mol_type = other DNA
tcaaactactcgccatag

SEQ ID NO: 63247 - DNA, 18 bp, synthetic construct
  source 1..18: mol_type = other DNA
tcaaagaactcactaaag

SEQ ID NO: 63248 - DNA, 18 bp, synthetic construct
  source 1..18: mol_type = other DNA
tcaaatgccacactgtag

SEQ ID NO: 63249 - DNA, 18 bp, synthetic construct
  source 1..18: mol_type = other DNA
tcaaattagacactaaag

SEQ ID NO: 63250 - DNA, 18 bp, synthetic construct
  source 1..18: mol_type = other DNA
tcaatcgaaacactatag

SEQ ID NO: 63251 - DNA, 18 bp, synthetic construct
  source 1..18: mol_type = other DNA
tcaattgattcaccataa

SEQ ID NO: 63252 - DNA, 18 bp, synthetic construct
  source 1..18: mol_type = other DNA
tcacacgtctcactaatg

SEQ ID NO: 63253 - DNA, 18 bp, synthetic construct
  source 1..18: mol_type = other DNA
tcacgcgattctctatag

SEQ ID NO: 63254 - DNA, 18 bp, synthetic construct
  source 1..18: mol_type = other DNA
tcagacaactctctgtcg

SEQ ID NO: 63255 - DNA, 18 bp, synthetic construct
  source 1..18: mol_type = other DNA
tcagttgtctcactttag

SEQ ID NO: 63256 - DNA, 18 bp, synthetic construct
  source 1..18: mol_type = other DNA
tcataacgctcactctag

SEQ ID NO: 63257 - DNA, 18 bp, synthetic construct
  source 1..18: mol_type = other DNA
tcataagacttacttatg

SEQ ID NO: 63258 - DNA, 18 bp, synthetic construct
  source 1..18: mol_type = other DNA
tcataagactttccatag

SEQ ID NO: 63259 - DNA, 18 bp, synthetic construct
  source 1..18: mol_type = other DNA
tcatacaacacacaattg

SEQ ID NO: 63260 - DNA, 18 bp, synthetic construct
  source 1..18: mol_type = other DNA
tcatacaacactctattg

SEQ ID NO: 63261 - DNA, 18 bp, synthetic construct
  source 1..18: mol_type = other DNA
tcatacaattctcctctg

SEQ ID NO: 63262 - DNA, 18 bp, synthetic construct
  source 1..18: mol_type = other DNA
tcatacagctcaaaaatg

SEQ ID NO: 63263 - DNA, 18 bp, synthetic construct
  source 1..18: mol_type = other DNA
tcatacatcacacaatag

SEQ ID NO: 63264 - DNA, 18 bp, synthetic construct
  source 1..18: mol_type = other DNA
tcatacatttcgctatcg

SEQ ID NO: 63265 - DNA, 18 bp, synthetic construct
  source 1..18: mol_type = other DNA
tcataccaatcgctaaag

SEQ ID NO: 63266 - DNA, 18 bp, synthetic construct
  source 1..18: mol_type = other DNA
tcataccactaactcaag

SEQ ID NO: 63267 - DNA, 18 bp, synthetic construct
  source 1..18: mol_type = other DNA
tcatacgacacacatttg

SEQ ID NO: 63268 - DNA, 18 bp, synthetic construct
  source 1..18: mol_type = other DNA
tcatacgacccgctgaag

SEQ ID NO: 63269 - DNA, 18 bp, synthetic construct
  source 1..18: mol_type = other DNA
tcatacgactatctctcg

SEQ ID NO: 63270 - DNA, 18 bp, synthetic construct
  source 1..18: mol_type = other DNA
tcatacgagacggctgag

SEQ ID NO: 63271 - DNA, 18 bp, synthetic construct
  source 1..18: mol_type = other DNA
tcatacgagtaattaaag

SEQ ID NO: 63272 - DNA, 18 bp, synthetic construct
  source 1..18: mol_type = other DNA
tcatacgattaataatag

SEQ ID NO: 63273 - DNA, 18 bp, synthetic construct
  source 1..18: mol_type = other DNA
tcatacgccttacaaaag

SEQ ID NO: 63274 - DNA, 18 bp, synthetic construct
  source 1..18: mol_type = other DNA
tcatacggcatactattg

SEQ ID NO: 63275 - DNA, 18 bp, synthetic construct
  source 1..18: mol_type = other DNA
tcatacgtcttactcatg

SEQ ID NO: 63276 - DNA, 18 bp, synthetic construct
  source 1..18: mol_type = other DNA
tcatacgtcttattattg

SEQ ID NO: 63277 - DNA, 18 bp, synthetic construct
  source 1..18: mol_type = other DNA
tcatacgttactctttag

SEQ ID NO: 63278 - DNA, 18 bp, synthetic construct
  source 1..18: mol_type = other DNA
tcatacgttttactattg

SEQ ID NO: 63279 - DNA, 18 bp, synthetic construct
  source 1..18: mol_type = other DNA
tcatactacgcattttag

SEQ ID NO: 63280 - DNA, 18 bp, synthetic construct
  source 1..18: mol_type = other DNA
tcatacttctcacatttg

SEQ ID NO: 63281 - DNA, 18 bp, synthetic construct
  source 1..18: mol_type = other DNA
tcatacttctcattaaag

SEQ ID NO: 63282 - DNA, 18 bp, synthetic construct
  source 1..18: mol_type = other DNA
tcataggactccctaatg

SEQ ID NO: 63283 - DNA, 18 bp, synthetic construct
  source 1..18: mol_type = other DNA
tcataggactctctgccg

SEQ ID NO: 63284 - DNA, 18 bp, synthetic construct
  source 1..18: mol_type = other DNA
tcataggatttgcaatag

SEQ ID NO: 63285 - DNA, 18 bp, synthetic construct
  source 1..18: mol_type = other DNA
tcatatatcccacttcag

SEQ ID NO: 63286 - DNA, 18 bp, synthetic construct
  source 1..18: mol_type = other DNA
tcatatcactctatatag

SEQ ID NO: 63287 - DNA, 18 bp, synthetic construct
  source 1..18: mol_type = other DNA
tcatatgtctcacctaag

SEQ ID NO: 63288 - DNA, 18 bp, synthetic construct
  source 1..18: mol_type = other DNA
tcatattagtcactaaag

SEQ ID NO: 63289 - DNA, 18 bp, synthetic construct
  source 1..18: mol_type = other DNA
tcatccgactgaatatcg

SEQ ID NO: 63290 - DNA, 18 bp, synthetic construct
  source 1..18: mol_type = other DNA
tcatccttttcaccagag

SEQ ID NO: 63291 - DNA, 18 bp, synthetic construct
  source 1..18: mol_type = other DNA
tcatgcgacgcaatttcg

SEQ ID NO: 63292 - DNA, 18 bp, synthetic construct
  source 1..18: mol_type = other DNA
tcatgcgattcaatattg

SEQ ID NO: 63293 - DNA, 18 bp, synthetic construct
  source 1..18: mol_type = other DNA
tcatgctactaccaattg

SEQ ID NO: 63294 - DNA, 18 bp, synthetic construct
  source 1..18: mol_type = other DNA
tcatgtgactaactaacg

SEQ ID NO: 63295 - DNA, 18 bp, synthetic construct
  source 1..18: mol_type = other DNA
tcattagactcattttcg

SEQ ID NO: 63296 - DNA, 18 bp, synthetic construct
  source 1..18: mol_type = other DNA
tcattagactctctcatg

SEQ ID NO: 63297 - DNA, 18 bp, synthetic construct
  source 1..18: mol_type = other DNA
tcattagtctaaatacag

SEQ ID NO: 63298 - DNA, 18 bp, synthetic construct
  source 1..18: mol_type = other DNA
tcattcaaattacgatag

SEQ ID NO: 63299 - DNA, 18 bp, synthetic construct
  source 1..18: mol_type = other DNA
tcattcacctcactgaag

SEQ ID NO: 63300 - DNA, 18 bp, synthetic construct
  source 1..18: mol_type = other DNA
tcattcgaatcacattag

SEQ ID NO: 63301 - DNA, 18 bp, synthetic construct
  source 1..18: mol_type = other DNA
tcattcgactatatttag

SEQ ID NO: 63302 - DNA, 18 bp, synthetic construct
  source 1..18: mol_type = other DNA
tcattcgacttaattgag

SEQ ID NO: 63303 - DNA, 18 bp, synthetic construct
  source 1..18: mol_type = other DNA
tcattcgattctctaaag

SEQ ID NO: 63304 - DNA, 18 bp, synthetic construct
  source 1..18: mol_type = other DNA
tcattcggctttctatag

SEQ ID NO: 63305 - DNA, 18 bp, synthetic construct
  source 1..18: mol_type = other DNA
tcattcgtcgcaatattg

SEQ ID NO: 63306 - DNA, 18 bp, synthetic construct
  source 1..18: mol_type = other DNA
tcattcgtctttttatag

SEQ ID NO: 63307 - DNA, 18 bp, synthetic construct
  source 1..18: mol_type = other DNA
tcattcgtgtcacttaag

SEQ ID NO: 63308 - DNA, 18 bp, synthetic construct
  source 1..18: mol_type = other DNA
tcattctactatctactg

SEQ ID NO: 63309 - DNA, 18 bp, synthetic construct
  source 1..18: mol_type = other DNA
tcattctattcataattg

SEQ ID NO: 63310 - DNA, 18 bp, synthetic construct
  source 1..18: mol_type = other DNA
tcattcttatcgctatag

SEQ ID NO: 63311 - DNA, 18 bp, synthetic construct
  source 1..18: mol_type = other DNA
tccaaatatacattaatg

SEQ ID NO: 63312 - DNA, 18 bp, synthetic construct
  source 1..18: mol_type = other DNA
tccaataactgtctacag

SEQ ID NO: 63313 - DNA, 18 bp, synthetic construct
  source 1..18: mol_type = other DNA
tcccacatctcactcaag

SEQ ID NO: 63314 - DNA, 18 bp, synthetic construct
  source 1..18: mol_type = other DNA
tcccactacccactatag

SEQ ID NO: 63315 - DNA, 18 bp, synthetic construct
  source 1..18: mol_type = other DNA
tcctacgtctcattttag

SEQ ID NO: 63316 - DNA, 18 bp, synthetic construct
  source 1..18: mol_type = other DNA
tcctaggactcaccaaag

SEQ ID NO: 63317 - DNA, 18 bp, synthetic construct
  source 1..18: mol_type = other DNA
tcctatgactccctattg

SEQ ID NO: 63318 - DNA, 18 bp, synthetic construct
  source 1..18: mol_type = other DNA
tcctatgacttaataaag

SEQ ID NO: 63319 - DNA, 18 bp, synthetic construct
  source 1..18: mol_type = other DNA
tccttcgtcttacaatag

SEQ ID NO: 63320 - DNA, 18 bp, synthetic construct
  source 1..18: mol_type = other DNA
tcgaacgtaacacgattg

SEQ ID NO: 63321 - DNA, 18 bp, synthetic construct
  source 1..18: mol_type = other DNA
tcgaacgttttactttag

SEQ ID NO: 63322 - DNA, 18 bp, synthetic construct
  source 1..18: mol_type = other DNA
tcgcaccatccacttttg

SEQ ID NO: 63323 - DNA, 18 bp, synthetic construct
  source 1..18: mol_type = other DNA
tcgtaagccttcctaatg

SEQ ID NO: 63324 - DNA, 18 bp, synthetic construct
  source 1..18: mol_type = other DNA
tcgtacgactgtgtaacg

SEQ ID NO: 63325 - DNA, 18 bp, synthetic construct
  source 1..18: mol_type = other DNA
tcgtacgattctcaattg

SEQ ID NO: 63326 - DNA, 18 bp, synthetic construct
  source 1..18: mol_type = other DNA
tcgtactcctcactaatg

SEQ ID NO: 63327 - DNA, 18 bp, synthetic construct
  source 1..18: mol_type = other DNA
tcgttcgactaactattg

SEQ ID NO: 63328 - DNA, 18 bp, synthetic construct
  source 1..18: mol_type = other DNA
tcgtttcattctctgtag

SEQ ID NO: 63329 - DNA, 18 bp, synthetic construct
  source 1..18: mol_type = other DNA
tctaacaaatcactagag

SEQ ID NO: 63330 - DNA, 18 bp, synthetic construct
  source 1..18: mol_type = other DNA
tctaacgactcacaaatg

SEQ ID NO: 63331 - DNA, 18 bp, synthetic construct
  source 1..18: mol_type = other DNA
tctaacgagtcaccatag

SEQ ID NO: 63332 - DNA, 18 bp, synthetic construct
  source 1..18: mol_type = other DNA
tctaacgattcaatatag

SEQ ID NO: 63333 - DNA, 18 bp, synthetic construct
  source 1..18: mol_type = other DNA
tctcaagactccctatag

SEQ ID NO: 63334 - DNA, 18 bp, synthetic construct
  source 1..18: mol_type = other DNA
tctgacgactaagtttag

SEQ ID NO: 63335 - DNA, 18 bp, synthetic construct
  source 1..18: mol_type = other DNA
tctgtcgaatcattttag

SEQ ID NO: 63336 - DNA, 18 bp, synthetic construct
  source 1..18: mol_type = other DNA
tcttaaaactcactaatg

SEQ ID NO: 63337 - DNA, 18 bp, synthetic construct
  source 1..18: mol_type = other DNA
tcttaaggctcaccaaag

SEQ ID NO: 63338 - DNA, 18 bp, synthetic construct
  source 1..18: mol_type = other DNA
tcttaagtcttttaatag

SEQ ID NO: 63339 - DNA, 18 bp, synthetic construct
  source 1..18: mol_type = other DNA
tcttaattatcacgatag

SEQ ID NO: 63340 - DNA, 18 bp, synthetic construct
  source 1..18: mol_type = other DNA
tcttacaactaacaatag

SEQ ID NO: 63341 - DNA, 18 bp, synthetic construct
  source 1..18: mol_type = other DNA
tcttacatctcactattg

SEQ ID NO: 63342 - DNA, 18 bp, synthetic construct
  source 1..18: mol_type = other DNA
tcttaccactcggtatag

SEQ ID NO: 63343 - DNA, 18 bp, synthetic construct
  source 1..18: mol_type = other DNA
tcttacgactctttttag

SEQ ID NO: 63344 - DNA, 18 bp, synthetic construct
  source 1..18: mol_type = other DNA
tcttacgactttctaaag

SEQ ID NO: 63345 - DNA, 18 bp, synthetic construct
  source 1..18: mol_type = other DNA
tcttacgattaactttag

SEQ ID NO: 63346 - DNA, 18 bp, synthetic construct
  source 1..18: mol_type = other DNA
tcttacgtctcgctaaag

SEQ ID NO: 63347 - DNA, 18 bp, synthetic construct
  source 1..18: mol_type = other DNA
tcttactacactcttaag

SEQ ID NO: 63348 - DNA, 18 bp, synthetic construct
  source 1..18: mol_type = other DNA
tcttagcactgtgtattg

SEQ ID NO: 63349 - DNA, 18 bp, synthetic construct
  source 1..18: mol_type = other DNA
tcttatgactcgcgatag

SEQ ID NO: 63350 - DNA, 18 bp, synthetic construct
  source 1..18: mol_type = other DNA
tcttattacactatatag

SEQ ID NO: 63351 - DNA, 18 bp, synthetic construct
  source 1..18: mol_type = other DNA
tcttccgtgtcactatag

SEQ ID NO: 63352 - DNA, 18 bp, synthetic construct
  source 1..18: mol_type = other DNA
tcttgcaactcaacacag

SEQ ID NO: 63353 - DNA, 18 bp, synthetic construct
  source 1..18: mol_type = other DNA
tctttcgtcgcactatag

SEQ ID NO: 63354 - DNA, 18 bp, synthetic construct
  source 1..18: mol_type = other DNA
tctttctgcctacttttg

SEQ ID NO: 63355 - DNA, 18 bp, synthetic construct
  source 1..18: mol_type = other DNA
tgaaaagactccctttag

SEQ ID NO: 63356 - DNA, 18 bp, synthetic construct
  source 1..18: mol_type = other DNA
tgaaaagtatgattatag

SEQ ID NO: 63357 - DNA, 18 bp, synthetic construct
  source 1..18: mol_type = other DNA
tgaaacgactcttaatag

SEQ ID NO: 63358 - DNA, 18 bp, synthetic construct
  source 1..18: mol_type = other DNA
tgaaacgtctatatatag

SEQ ID NO: 63359 - DNA, 18 bp, synthetic construct
  source 1..18: mol_type = other DNA
tgaaacgtttcgctatag

SEQ ID NO: 63360 - DNA, 18 bp, synthetic construct
  source 1..18: mol_type = other DNA
tgaaatgtcccatcatag

SEQ ID NO: 63361 - DNA, 18 bp, synthetic construct
  source 1..18: mol_type = other DNA
tgaaatgtcttactatcg

SEQ ID NO: 63362 - DNA, 18 bp, synthetic construct
  source 1..18: mol_type = other DNA
tgaaattattcactatag

SEQ ID NO: 63363 - DNA, 18 bp, synthetic construct
  source 1..18: mol_type = other DNA
tgaatcaatccactaaag

SEQ ID NO: 63364 - DNA, 18 bp, synthetic construct
  source 1..18: mol_type = other DNA
tgaatccgcactatatag

SEQ ID NO: 63365 - DNA, 18 bp, synthetic construct
  source 1..18: mol_type = other DNA
tgaatcgactcactttgg

SEQ ID NO: 63366 - DNA, 18 bp, synthetic construct
  source 1..18: mol_type = other DNA
tgaatcgagtcactaagg

SEQ ID NO: 63367 - DNA, 18 bp, synthetic construct
  source 1..18: mol_type = other DNA
tgacacgtcccactactg

SEQ ID NO: 63368 - DNA, 18 bp, synthetic construct
  source 1..18: mol_type = other DNA
tgacactacacactattg

SEQ ID NO: 63369 - DNA, 18 bp, synthetic construct
  source 1..18: mol_type = other DNA
tgacactacacacttccg

SEQ ID NO: 63370 - DNA, 18 bp, synthetic construct
  source 1..18: mol_type = other DNA
tgacactcatcactatag

SEQ ID NO: 63371 - DNA, 18 bp, synthetic construct
  source 1..18: mol_type = other DNA
tgacacttctctcttaag

SEQ ID NO: 63372 - DNA, 18 bp, synthetic construct
  source 1..18: mol_type = other DNA
tgaccagtttcattatcg

SEQ ID NO: 63373 - DNA, 18 bp, synthetic construct
  source 1..18: mol_type = other DNA
tgactcgacacacaaaag

SEQ ID NO: 63374 - DNA, 18 bp, synthetic construct
  source 1..18: mol_type = other DNA
tgagatgactctttttag

SEQ ID NO: 63375 - DNA, 18 bp, synthetic construct
  source 1..18: mol_type = other DNA
tgagatgatacacttctg

SEQ ID NO: 63376 - DNA, 18 bp, synthetic construct
  source 1..18: mol_type = other DNA
tgagtaggatcactatag

SEQ ID NO: 63377 - DNA, 18 bp, synthetic construct
  source 1..18: mol_type = other DNA
tgataaaactcacatatg

SEQ ID NO: 63378 - DNA, 18 bp, synthetic construct
  source 1..18: mol_type = other DNA
tgataacacacactttag

SEQ ID NO: 63379 - DNA, 18 bp, synthetic construct
  source 1..18: mol_type = other DNA
tgataagacacgatattg

SEQ ID NO: 63380 - DNA, 18 bp, synthetic construct
  source 1..18: mol_type = other DNA
tgataagacccacaaaag

SEQ ID NO: 63381 - DNA, 18 bp, synthetic construct
  source 1..18: mol_type = other DNA
tgataagtttctctattg

SEQ ID NO: 63382 - DNA, 18 bp, synthetic construct
  source 1..18: mol_type = other DNA
tgatacaaatctatttag

SEQ ID NO: 63383 - DNA, 18 bp, synthetic construct
  source 1..18: mol_type = other DNA
tgatacctgtgactatag

SEQ ID NO: 63384 - DNA, 18 bp, synthetic construct
  source 1..18: mol_type = other DNA
tgatacgaaccacttaag

SEQ ID NO: 63385 - DNA, 18 bp, synthetic construct
  source 1..18: mol_type = other DNA
tgatacgaataagagtag

SEQ ID NO: 63386 - DNA, 18 bp, synthetic construct
  source 1..18: mol_type = other DNA
tgatacgacacatttttg

SEQ ID NO: 63387 - DNA, 18 bp, synthetic construct
  source 1..18: mol_type = other DNA
tgatacgactaccaattg

SEQ ID NO: 63388 - DNA, 18 bp, synthetic construct
  source 1..18: mol_type = other DNA
tgatacgccctatcattg

SEQ ID NO: 63389 - DNA, 18 bp, synthetic construct
  source 1..18: mol_type = other DNA
tgatacggctttccattg

SEQ ID NO: 63390 - DNA, 18 bp, synthetic construct
  source 1..18: mol_type = other DNA
tgatacgtcatatattcg

SEQ ID NO: 63391 - DNA, 18 bp, synthetic construct
  source 1..18: mol_type = other DNA
tgatacgtctcaatgttg

SEQ ID NO: 63392 - DNA, 18 bp, synthetic construct
  source 1..18: mol_type = other DNA
tgatacgtttgaccttag

SEQ ID NO: 63393 - DNA, 18 bp, synthetic construct
  source 1..18: mol_type = other DNA
tgataggacagtctgttg

SEQ ID NO: 63394 - DNA, 18 bp, synthetic construct
  source 1..18: mol_type = other DNA
tgataggactcaataagg

SEQ ID NO: 63395 - DNA, 18 bp, synthetic construct
  source 1..18: mol_type = other DNA
tgataggactctcactag

SEQ ID NO: 63396 - DNA, 18 bp, synthetic construct
  source 1..18: mol_type = other DNA
tgataggccttactcaag

SEQ ID NO: 63397 - DNA, 18 bp, synthetic construct
  source 1..18: mol_type = other DNA
tgatatcaatctctatag

SEQ ID NO: 63398 - DNA, 18 bp, synthetic construct
  source 1..18: mol_type = other DNA
tgatattatatactgtag

SEQ ID NO: 63399 - DNA, 18 bp, synthetic construct
  source 1..18: mol_type = other DNA
tgatcaaactcactatgg

SEQ ID NO: 63400 - DNA, 18 bp, synthetic construct
  source 1..18: mol_type = other DNA
tgatcagaatttcaatag

SEQ ID NO: 63401 - DNA, 18 bp, synthetic construct
  source 1..18: mol_type = other DNA
tgatccgacacagtaaag

SEQ ID NO: 63402 - DNA, 18 bp, synthetic construct
  source 1..18: mol_type = other DNA
tgatccgacacgctaaag

SEQ ID NO: 63403 - DNA, 18 bp, synthetic construct
  source 1..18: mol_type = other DNA
tgatccgtctctatatag

SEQ ID NO: 63404 - DNA, 18 bp, synthetic construct
  source 1..18: mol_type = other DNA
tgatccgtctcttaatag

SEQ ID NO: 63405 - DNA, 18 bp, synthetic construct
  source 1..18: mol_type = other DNA
tgatctgactcacagtag

SEQ ID NO: 63406 - DNA, 18 bp, synthetic construct
  source 1..18: mol_type = other DNA
tgatcttgctcacaatgg

SEQ ID NO: 63407 - DNA, 18 bp, synthetic construct
  source 1..18: mol_type = other DNA
tgatgccattctctttag

SEQ ID NO: 63408 - DNA, 18 bp, synthetic construct
  source 1..18: mol_type = other DNA
tgatgggactaggtctag

SEQ ID NO: 63409 - DNA, 18 bp, synthetic construct
  source 1..18: mol_type = other DNA
tgattactctaactatag

SEQ ID NO: 63410 - DNA, 18 bp, synthetic construct
  source 1..18: mol_type = other DNA
tgattcaaattacttaag

SEQ ID NO: 63411 - DNA, 18 bp, synthetic construct
  source 1..18: mol_type = other DNA
tgattcaacacaccatag

SEQ ID NO: 63412 - DNA, 18 bp, synthetic construct
  source 1..18: mol_type = other DNA
tgattccatttactatag

SEQ ID NO: 63413 - DNA, 18 bp, synthetic construct
  source 1..18: mol_type = other DNA
tgattcgaatatctatcg

SEQ ID NO: 63414 - DNA, 18 bp, synthetic construct
  source 1..18: mol_type = other DNA
tgattcgacaccatatag

SEQ ID NO: 63415 - DNA, 18 bp, synthetic construct
  source 1..18: mol_type = other DNA
tgattcgacattctatag

SEQ ID NO: 63416 - DNA, 18 bp, synthetic construct
  source 1..18: mol_type = other DNA
tgattcgacgccctctgg

SEQ ID NO: 63417 - DNA, 18 bp, synthetic construct
  source 1..18: mol_type = other DNA
tgattcgactcacacttg

SEQ ID NO: 63418 - DNA, 18 bp, synthetic construct
  source 1..18: mol_type = other DNA
tgattttactctctatag

SEQ ID NO: 63419 - DNA, 18 bp, synthetic construct
  source 1..18: mol_type = other DNA
tgctacgacacattaaag

SEQ ID NO: 63420 - DNA, 18 bp, synthetic construct
  source 1..18: mol_type = other DNA
tgctacgcctaactacag

SEQ ID NO: 63421 - DNA, 18 bp, synthetic construct
  source 1..18: mol_type = other DNA
tgctacgtaacactatag

SEQ ID NO: 63422 - DNA, 18 bp, synthetic construct
  source 1..18: mol_type = other DNA
tgctactacacattacag

SEQ ID NO: 63423 - DNA, 18 bp, synthetic construct
  source 1..18: mol_type = other DNA
tgctactccagagtatag

SEQ ID NO: 63424 - DNA, 18 bp, synthetic construct
  source 1..18: mol_type = other DNA
tggaaccactcctaatag

SEQ ID NO: 63425 - DNA, 18 bp, synthetic construct
  source 1..18: mol_type = other DNA
tggaacgacttactgttg

SEQ ID NO: 63426 - DNA, 18 bp, synthetic construct
  source 1..18: mol_type = other DNA
tggaacgattcgtaaaag

SEQ ID NO: 63427 - DNA, 18 bp, synthetic construct
  source 1..18: mol_type = other DNA
tggagcgtcttaccatag

SEQ ID NO: 63428 - DNA, 18 bp, synthetic construct
  source 1..18: mol_type = other DNA
tggtaagattcagtatag

SEQ ID NO: 63429 - DNA, 18 bp, synthetic construct
  source 1..18: mol_type = other DNA
tggtaccacttccttcag

SEQ ID NO: 63430 - DNA, 18 bp, synthetic construct
  source 1..18: mol_type = other DNA
tggtatgccgcattccag

SEQ ID NO: 63431 - DNA, 18 bp, synthetic construct
  source 1..18: mol_type = other DNA
tggttcgactctctttag

SEQ ID NO: 63432 - DNA, 18 bp, synthetic construct
  source 1..18: mol_type = other DNA
tgtaaagccacactatag

SEQ ID NO: 63433 - DNA, 18 bp, synthetic construct
  source 1..18: mol_type = other DNA
tgtaacgagtcattatag

SEQ ID NO: 63434 - DNA, 18 bp, synthetic construct
  source 1..18: mol_type = other DNA
tgtcacaactctctattg

SEQ ID NO: 63435 - DNA, 18 bp, synthetic construct
  source 1..18: mol_type = other DNA
tgtcacgtctgcttacag

SEQ ID NO: 63436 - DNA, 18 bp, synthetic construct
  source 1..18: mol_type = other DNA
tgttaagactcgttatag

SEQ ID NO: 63437 - DNA, 18 bp, synthetic construct
  source 1..18: mol_type = other DNA
tgttaatactcagaatag

SEQ ID NO: 63438 - DNA, 18 bp, synthetic construct
  source 1..18: mol_type = other DNA
tgttacaactcacaattg

SEQ ID NO: 63439 - DNA, 18 bp, synthetic construct
  source 1..18: mol_type = other DNA
tgttacaacttactggtg

SEQ ID NO: 63440 - DNA, 18 bp, synthetic construct
  source 1..18: mol_type = other DNA
tgttaccactaactctag

SEQ ID NO: 63441 - DNA, 18 bp, synthetic construct
  source 1..18: mol_type = other DNA
tgttacgtatgactaatg

SEQ ID NO: 63442 - DNA, 18 bp, synthetic construct
  source 1..18: mol_type = other DNA
tgttaggactcattgtag

SEQ ID NO: 63443 - DNA, 18 bp, synthetic construct
  source 1..18: mol_type = other DNA
tgttaggcatgccttgag

SEQ ID NO: 63444 - DNA, 18 bp, synthetic construct
  source 1..18: mol_type = other DNA
tgttagggctcactaaag

SEQ ID NO: 63445 - DNA, 18 bp, synthetic construct
  source 1..18: mol_type = other DNA
tgttatgactctatcttg

SEQ ID NO: 63446 - DNA, 18 bp, synthetic construct
  source 1..18: mol_type = other DNA
tgttcagacgatctaaag

SEQ ID NO: 63447 - DNA, 18 bp, synthetic construct
  source 1..18: mol_type = other DNA
tgttcagactcactaaag

SEQ ID NO: 63448 - DNA, 18 bp, synthetic construct
  source 1..18: mol_type = other DNA
tgttcagacttcctttag

SEQ ID NO: 63449 - DNA, 18 bp, synthetic construct
  source 1..18: mol_type = other DNA
tgtttcaacaaacaatag

SEQ ID NO: 63450 - DNA, 18 bp, synthetic construct
  source 1..18: mol_type = other DNA
tgtttcaactcactattg

SEQ ID NO: 63451 - DNA, 18 bp, synthetic construct
  source 1..18: mol_type = other DNA
tgtttcgactctcaaccg

SEQ ID NO: 63452 - DNA, 18 bp, synthetic construct
  source 1..18: mol_type = other DNA
tgtttcgatttactatag

SEQ ID NO: 63453 - DNA, 18 bp, synthetic construct
  source 1..18: mol_type = other DNA
tgtttcttataactatag

SEQ ID NO: 63454 - DNA, 18 bp, synthetic construct
  source 1..18: mol_type = other DNA
tgttttaactcacaatag

SEQ ID NO: 63455 - DNA, 18 bp, synthetic construct
  source 1..18: mol_type = other DNA
ttaaaagcctccctacag

SEQ ID NO: 63456 - DNA, 18 bp, synthetic construct
  source 1..18: mol_type = other DNA
ttaaacaacacagtattg

SEQ ID NO: 63457 - DNA, 18 bp, synthetic construct
  source 1..18: mol_type = other DNA
ttaaacaattcgctgtag

SEQ ID NO: 63458 - DNA, 18 bp, synthetic construct
  source 1..18: mol_type = other DNA
ttaaaccactctatatag

SEQ ID NO: 63459 - DNA, 18 bp, synthetic construct
  source 1..18: mol_type = other DNA
ttaaacgaatcacgatcg

SEQ ID NO: 63460 - DNA, 18 bp, synthetic construct
  source 1..18: mol_type = other DNA
ttaaacgacccattatgg

SEQ ID NO: 63461 - DNA, 18 bp, synthetic construct
  source 1..18: mol_type = other DNA
ttaaacgaccgtctcttg

SEQ ID NO: 63462 - DNA, 18 bp, synthetic construct
  source 1..18: mol_type = other DNA
ttaaacgacgctctaatg

SEQ ID NO: 63463 - DNA, 18 bp, synthetic construct
  source 1..18: mol_type = other DNA
ttaaacgactaaataaag

SEQ ID NO: 63464 - DNA, 18 bp, synthetic construct
  source 1..18: mol_type = other DNA
ttaaacgactaactcaag

SEQ ID NO: 63465 - DNA, 18 bp, synthetic construct
  source 1..18: mol_type = other DNA
ttaaacgactcatgaaag

SEQ ID NO: 63466 - DNA, 18 bp, synthetic construct
  source 1..18: mol_type = other DNA
ttaaacgactcatttcag

SEQ ID NO: 63467 - DNA, 18 bp, synthetic construct
  source 1..18: mol_type = other DNA
ttaaacgactcccaacgg

SEQ ID NO: 63468 - DNA, 18 bp, synthetic construct
  source 1..18: mol_type = other DNA
ttaaacgactctcttatg

SEQ ID NO: 63469 - DNA, 18 bp, synthetic construct
  source 1..18: mol_type = other DNA
ttaaacgatacactaaag

SEQ ID NO: 63470 - DNA, 18 bp, synthetic construct
  source 1..18: mol_type = other DNA
ttaaacgccacagtagtg

SEQ ID NO: 63471 - DNA, 18 bp, synthetic construct
  source 1..18: mol_type = other DNA
ttaaacgccttgctattg

SEQ ID NO: 63472 - DNA, 18 bp, synthetic construct
  source 1..18: mol_type = other DNA
ttaaacggctcataattg

SEQ ID NO: 63473 - DNA, 18 bp, synthetic construct
  source 1..18: mol_type = other DNA
ttaaactacttactattg

SEQ ID NO: 63474 - DNA, 18 bp, synthetic construct
  source 1..18: mol_type = other DNA
ttaaactattcattaatg

SEQ ID NO: 63475 - DNA, 18 bp, synthetic construct
  source 1..18: mol_type = other DNA
ttaaataactcaatatag

SEQ ID NO: 63476 - DNA, 18 bp, synthetic construct
  source 1..18: mol_type = other DNA
ttaaatgtctcacgaccg

SEQ ID NO: 63477 - DNA, 18 bp, synthetic construct
  source 1..18: mol_type = other DNA
ttaaattactcaatttag

SEQ ID NO: 63478 - DNA, 18 bp, synthetic construct
  source 1..18: mol_type = other DNA
ttaaccgacagactatag

SEQ ID NO: 63479 - DNA, 18 bp, synthetic construct
  source 1..18: mol_type = other DNA
ttaaccgactcactaatg

SEQ ID NO: 63480 - DNA, 18 bp, synthetic construct
  source 1..18: mol_type = other DNA
ttaaccgcaccactatag

SEQ ID NO: 63481 - DNA, 18 bp, synthetic construct
  source 1..18: mol_type = other DNA
ttaagcaacttattatag

SEQ ID NO: 63482 - DNA, 18 bp, synthetic construct
  source 1..18: mol_type = other DNA
ttaagcgactagctatag

SEQ ID NO: 63483 - DNA, 18 bp, synthetic construct
  source 1..18: mol_type = other DNA
ttaagcgactcactaagg

SEQ ID NO: 63484 - DNA, 18 bp, synthetic construct
  source 1..18: mol_type = other DNA
ttaagcgagtctctattg

SEQ ID NO: 63485 - DNA, 18 bp, synthetic construct
  source 1..18: mol_type = other DNA
ttaatattctcactatcg

SEQ ID NO: 63486 - DNA, 18 bp, synthetic construct
  source 1..18: mol_type = other DNA
ttaatcatttcactttgg

SEQ ID NO: 63487 - DNA, 18 bp, synthetic construct
  source 1..18: mol_type = other DNA
ttaatcgaataactacag

SEQ ID NO: 63488 - DNA, 18 bp, synthetic construct
  source 1..18: mol_type = other DNA
ttaatcgactatctttag

SEQ ID NO: 63489 - DNA, 18 bp, synthetic construct
  source 1..18: mol_type = other DNA
ttaatcgacttactattg

SEQ ID NO: 63490 - DNA, 18 bp, synthetic construct
  source 1..18: mol_type = other DNA
ttaatcgagtctctatag

SEQ ID NO: 63491 - DNA, 18 bp, synthetic construct
  source 1..18: mol_type = other DNA
ttaatctacattcaatag

SEQ ID NO: 63492 - DNA, 18 bp, synthetic construct
  source 1..18: mol_type = other DNA
ttaattaacccactaaag

SEQ ID NO: 63493 - DNA, 18 bp, synthetic construct
  source 1..18: mol_type = other DNA
ttacacgaatcactaatg

SEQ ID NO: 63494 - DNA, 18 bp, synthetic construct
  source 1..18: mol_type = other DNA
ttacacgacacattaaag

SEQ ID NO: 63495 - DNA, 18 bp, synthetic construct
  source 1..18: mol_type = other DNA
ttacactacacgctatag

SEQ ID NO: 63496 - DNA, 18 bp, synthetic construct
  source 1..18: mol_type = other DNA
ttacactacttcattttg

SEQ ID NO: 63497 - DNA, 18 bp, synthetic construct
  source 1..18: mol_type = other DNA
ttacatcactctttaaag

SEQ ID NO: 63498 - DNA, 18 bp, synthetic construct
  source 1..18: mol_type = other DNA
ttacctgtcactcaaaag

SEQ ID NO: 63499 - DNA, 18 bp, synthetic construct
  source 1..18: mol_type = other DNA
ttacgagactcactttag

SEQ ID NO: 63500 - DNA, 18 bp, synthetic construct
  source 1..18: mol_type = other DNA
ttactatagtcactatgg

SEQ ID NO: 63501 - DNA, 18 bp, synthetic construct
  source 1..18: mol_type = other DNA
ttactccattcactttag

SEQ ID NO: 63502 - DNA, 18 bp, synthetic construct
  source 1..18: mol_type = other DNA
ttactcgacccacaatgg

SEQ ID NO: 63503 - DNA, 18 bp, synthetic construct
  source 1..18: mol_type = other DNA
ttagacgacccaatctag

SEQ ID NO: 63504 - DNA, 18 bp, synthetic construct
  source 1..18: mol_type = other DNA
ttagactagacgcgatag

SEQ ID NO: 63505 - DNA, 18 bp, synthetic construct
  source 1..18: mol_type = other DNA
ttaggctacacagtgaag

SEQ ID NO: 63506 - DNA, 18 bp, synthetic construct
  source 1..18: mol_type = other DNA
ttataaaaccaattatag

SEQ ID NO: 63507 - DNA, 18 bp, synthetic construct
  source 1..18: mol_type = other DNA
ttataaatccaactatag

SEQ ID NO: 63508 - DNA, 18 bp, synthetic construct
  source 1..18: mol_type = other DNA
ttataacattcacaaaag

SEQ ID NO: 63509 - DNA, 18 bp, synthetic construct
  source 1..18: mol_type = other DNA
ttataactatgtgaatag

SEQ ID NO: 63510 - DNA, 18 bp, synthetic construct
  source 1..18: mol_type = other DNA
ttataagacacaaattag

SEQ ID NO: 63511 - DNA, 18 bp, synthetic construct
  source 1..18: mol_type = other DNA
ttataagacaccatatag

SEQ ID NO: 63512 - DNA, 18 bp, synthetic construct
  source 1..18: mol_type = other DNA
ttataagagtcaggatag

SEQ ID NO: 63513 - DNA, 18 bp, synthetic construct
  source 1..18: mol_type = other DNA
ttataagccaccctattg

SEQ ID NO: 63514 - DNA, 18 bp, synthetic construct
  source 1..18: mol_type = other DNA
ttataagtctcgctttag

SEQ ID NO: 63515 - DNA, 18 bp, synthetic construct
  source 1..18: mol_type = other DNA
ttataatactccttatag

SEQ ID NO: 63516 - DNA, 18 bp, synthetic construct
  source 1..18: mol_type = other DNA
ttatacaaatctttatag

SEQ ID NO: 63517 - DNA, 18 bp, synthetic construct
  source 1..18: mol_type = other DNA
ttatacaacacaatttag

SEQ ID NO: 63518 - DNA, 18 bp, synthetic construct
  source 1..18: mol_type = other DNA
ttatacaacactctttag

SEQ ID NO: 63519 - DNA, 18 bp, synthetic construct
  source 1..18: mol_type = other DNA
ttatacaactcaataatg

SEQ ID NO: 63520 - DNA, 18 bp, synthetic construct
  source 1..18: mol_type = other DNA
ttatacaactgactactg

SEQ ID NO: 63521 - DNA, 18 bp, synthetic construct
  source 1..18: mol_type = other DNA
ttatacacatcgatatgg

SEQ ID NO: 63522 - DNA, 18 bp, synthetic construct
  source 1..18: mol_type = other DNA
ttatacacctctctattg

SEQ ID NO: 63523 - DNA, 18 bp, synthetic construct
  source 1..18: mol_type = other DNA
ttataccacaccccagag

SEQ ID NO: 63524 - DNA, 18 bp, synthetic construct
  source 1..18: mol_type = other DNA
ttatacctatcactaaag

SEQ ID NO: 63525 - DNA, 18 bp, synthetic construct
  source 1..18: mol_type = other DNA
ttatacctttctcttgag

SEQ ID NO: 63526 - DNA, 18 bp, synthetic construct
  source 1..18: mol_type = other DNA
ttatacgaacgactttag

SEQ ID NO: 63527 - DNA, 18 bp, synthetic construct
  source 1..18: mol_type = other DNA
ttatacgaatcgctctgg

SEQ ID NO: 63528 - DNA, 18 bp, synthetic construct
  source 1..18: mol_type = other DNA
ttatacgaattcatttcg

SEQ ID NO: 63529 - DNA, 18 bp, synthetic construct
  source 1..18: mol_type = other DNA
ttatacgacagactttgg

SEQ ID NO: 63530 - DNA, 18 bp, synthetic construct
  source 1..18: mol_type = other DNA
ttatacgactcgcataaa

SEQ ID NO: 63531 - DNA, 18 bp, synthetic construct
  source 1..18: mol_type = other DNA
ttatacgactcgcctatg

SEQ ID NO: 63532 - DNA, 18 bp, synthetic construct
  source 1..18: mol_type = other DNA
ttatacgactctcacttg

SEQ ID NO: 63533 - DNA, 18 bp, synthetic construct
  source 1..18: mol_type = other DNA
ttatacgactttccctcg

SEQ ID NO: 63534 - DNA, 18 bp, synthetic construct
  source 1..18: mol_type = other DNA
ttatacgagcctctttag

SEQ ID NO: 63535 - DNA, 18 bp, synthetic construct
  source 1..18: mol_type = other DNA
ttatacgagtatctttag

SEQ ID NO: 63536 - DNA, 18 bp, synthetic construct
  source 1..18: mol_type = other DNA
ttatacgataaaccatag

SEQ ID NO: 63537 - DNA, 18 bp, synthetic construct
  source 1..18: mol_type = other DNA
ttatacgatccgctattg

SEQ ID NO: 63538 - DNA, 18 bp, synthetic construct
  source 1..18: mol_type = other DNA
ttatacgatcctcaagag

SEQ ID NO: 63539 - DNA, 18 bp, synthetic construct
  source 1..18: mol_type = other DNA
ttatacgattacatattg

SEQ ID NO: 63540 - DNA, 18 bp, synthetic construct
  source 1..18: mol_type = other DNA
ttatacgattcaatgaag

SEQ ID NO: 63541 - DNA, 18 bp, synthetic construct
  source 1..18: mol_type = other DNA
ttatacgattctccattg

SEQ ID NO: 63542 - DNA, 18 bp, synthetic construct
  source 1..18: mol_type = other DNA
ttatacgcccaattatag

SEQ ID NO: 63543 - DNA, 18 bp, synthetic construct
  source 1..18: mol_type = other DNA
ttatacgcctcacttatg

SEQ ID NO: 63544 - DNA, 18 bp, synthetic construct
  source 1..18: mol_type = other DNA
ttatacgcctcagtaatg

SEQ ID NO: 63545 - DNA, 18 bp, synthetic construct
  source 1..18: mol_type = other DNA
ttatacgccttcctttag

SEQ ID NO: 63546 - DNA, 18 bp, synthetic construct
  source 1..18: mol_type = other DNA
ttatacggatcacaaatg

SEQ ID NO: 63547 - DNA, 18 bp, synthetic construct
  source 1..18: mol_type = other DNA
ttatacggcaaactatgg

SEQ ID NO: 63548 - DNA, 18 bp, synthetic construct
  source 1..18: mol_type = other DNA
ttatacggcttactgttg

SEQ ID NO: 63549 - DNA, 18 bp, synthetic construct
  source 1..18: mol_type = other DNA
ttatacggctttttatag

SEQ ID NO: 63550 - DNA, 18 bp, synthetic construct
  source 1..18: mol_type = other DNA
ttatacggtttcctttcg

SEQ ID NO: 63551 - DNA, 18 bp, synthetic construct
  source 1..18: mol_type = other DNA
ttatacgtatcacttagg

SEQ ID NO: 63552 - DNA, 18 bp, synthetic construct
  source 1..18: mol_type = other DNA
ttatacgtatcgctatcg

SEQ ID NO: 63553 - DNA, 18 bp, synthetic construct
  source 1..18: mol_type = other DNA
ttatacgtcacagactag

SEQ ID NO: 63554 - DNA, 18 bp, synthetic construct
  source 1..18: mol_type = other DNA
ttatacgtcagaccatag

SEQ ID NO: 63555 - DNA, 18 bp, synthetic construct
  source 1..18: mol_type = other DNA
ttatacgtcatactgtag

SEQ ID NO: 63556 - DNA, 18 bp, synthetic construct
  source 1..18: mol_type = other DNA
ttatacgtctaaattaag

SEQ ID NO: 63557 - DNA, 18 bp, synthetic construct
  source 1..18: mol_type = other DNA
ttatacgtctatctacag

SEQ ID NO: 63558 - DNA, 18 bp, synthetic construct
  source 1..18: mol_type = other DNA
ttatacgtctcagtccag

SEQ ID NO: 63559 - DNA, 18 bp, synthetic construct
  source 1..18: mol_type = other DNA
ttatacgtctcgcaaaag

SEQ ID NO: 63560 - DNA, 18 bp, synthetic construct
  source 1..18: mol_type = other DNA
ttatacgtctttcaatcg

SEQ ID NO: 63561 - DNA, 18 bp, synthetic construct
  source 1..18: mol_type = other DNA
ttatacgtgccatttttg

SEQ ID NO: 63562 - DNA, 18 bp, synthetic construct
  source 1..18: mol_type = other DNA
ttatacgtttcactatca

SEQ ID NO: 63563 - DNA, 18 bp, synthetic construct
  source 1..18: mol_type = other DNA
ttatactactaccgatcg

SEQ ID NO: 63564 - DNA, 18 bp, synthetic construct
  source 1..18: mol_type = other DNA
ttatactactcacttagg

SEQ ID NO: 63565 - DNA, 18 bp, synthetic construct
  source 1..18: mol_type = other DNA
ttatactactcagttttg

SEQ ID NO: 63566 - DNA, 18 bp, synthetic construct
  source 1..18: mol_type = other DNA
ttatactactctttattg

SEQ ID NO: 63567 - DNA, 18 bp, synthetic construct
  source 1..18: mol_type = other DNA
ttatactagtcattgtgg

SEQ ID NO: 63568 - DNA, 18 bp, synthetic construct
  source 1..18: mol_type = other DNA
ttatactattatataaag

SEQ ID NO: 63569 - DNA, 18 bp, synthetic construct
  source 1..18: mol_type = other DNA
ttatactattcattaaag

SEQ ID NO: 63570 - DNA, 18 bp, synthetic construct
  source 1..18: mol_type = other DNA
ttatactattctctaaag

SEQ ID NO: 63571 - DNA, 18 bp, synthetic construct
  source 1..18: mol_type = other DNA
ttatactcgtcactgtag

SEQ ID NO: 63572 - DNA, 18 bp, synthetic construct
  source 1..18: mol_type = other DNA
ttatacttcaaactaaag

SEQ ID NO: 63573 - DNA, 18 bp, synthetic construct
  source 1..18: mol_type = other DNA
ttatacttctcattatcg

SEQ ID NO: 63574 - DNA, 18 bp, synthetic construct
  source 1..18: mol_type = other DNA
ttatagaactcactgaag

SEQ ID NO: 63575 - DNA, 18 bp, synthetic construct
  source 1..18: mol_type = other DNA
ttatagagctcactttag

SEQ ID NO: 63576 - DNA, 18 bp, synthetic construct
  source 1..18: mol_type = other DNA
ttataggacaaactatgg

SEQ ID NO: 63577 - DNA, 18 bp, synthetic construct
  source 1..18: mol_type = other DNA
ttataggacagacactag

SEQ ID NO: 63578 - DNA, 18 bp, synthetic construct
  source 1..18: mol_type = other DNA
ttataggacccacattag

SEQ ID NO: 63579 - DNA, 18 bp, synthetic construct
  source 1..18: mol_type = other DNA
ttataggactagttattg

SEQ ID NO: 63580 - DNA, 18 bp, synthetic construct
  source 1..18: mol_type = other DNA
ttataggactctcaaaag

SEQ ID NO: 63581 - DNA, 18 bp, synthetic construct
  source 1..18: mol_type = other DNA
ttataggatactctttag

SEQ ID NO: 63582 - DNA, 18 bp, synthetic construct
  source 1..18: mol_type = other DNA
ttatataacacgaaatag

SEQ ID NO: 63583 - DNA, 18 bp, synthetic construct
  source 1..18: mol_type = other DNA
ttatataacactcaattg

SEQ ID NO: 63584 - DNA, 18 bp, synthetic construct
  source 1..18: mol_type = other DNA
ttatataactcaatttag

SEQ ID NO: 63585 - DNA, 18 bp, synthetic construct
  source 1..18: mol_type = other DNA
ttatataactctctattg

SEQ ID NO: 63586 - DNA, 18 bp, synthetic construct
  source 1..18: mol_type = other DNA
ttatataactctctgttg

SEQ ID NO: 63587 - DNA, 18 bp, synthetic construct
  source 1..18: mol_type = other DNA
ttatataacttatagtag

SEQ ID NO: 63588 - DNA, 18 bp, synthetic construct
  source 1..18: mol_type = other DNA
ttatatcactaaatatgg

SEQ ID NO: 63589 - DNA, 18 bp, synthetic construct
  source 1..18: mol_type = other DNA
ttatatctctcactatgg

SEQ ID NO: 63590 - DNA, 18 bp, synthetic construct
  source 1..18: mol_type = other DNA
ttatatgaagcactaaag

SEQ ID NO: 63591 - DNA, 18 bp, synthetic construct
  source 1..18: mol_type = other DNA
ttatatgactcacttatg

SEQ ID NO: 63592 - DNA, 18 bp, synthetic construct
  source 1..18: mol_type = other DNA
ttatatgatctcctatag

SEQ ID NO: 63593 - DNA, 18 bp, synthetic construct
  source 1..18: mol_type = other DNA
ttatatggctaactaaag

SEQ ID NO: 63594 - DNA, 18 bp, synthetic construct
  source 1..18: mol_type = other DNA
ttatatgtcttactttag

SEQ ID NO: 63595 - DNA, 18 bp, synthetic construct
  source 1..18: mol_type = other DNA
ttatatgtttcactacag

SEQ ID NO: 63596 - DNA, 18 bp, synthetic construct
  source 1..18: mol_type = other DNA
ttatatgtttcagaacag

SEQ ID NO: 63597 - DNA, 18 bp, synthetic construct
  source 1..18: mol_type = other DNA
ttatattacttacaaaag

SEQ ID NO: 63598 - DNA, 18 bp, synthetic construct
  source 1..18: mol_type = other DNA
ttatcacactttcaacag

SEQ ID NO: 63599 - DNA, 18 bp, synthetic construct
  source 1..18: mol_type = other DNA
ttatcagaatcactactg

SEQ ID NO: 63600 - DNA, 18 bp, synthetic construct
  source 1..18: mol_type = other DNA
ttatcagactaatgtttg

SEQ ID NO: 63601 - DNA, 18 bp, synthetic construct
  source 1..18: mol_type = other DNA
ttatccatatcacaaaag

SEQ ID NO: 63602 - DNA, 18 bp, synthetic construct
  source 1..18: mol_type = other DNA
ttatcccaatcacaacgg

SEQ ID NO: 63603 - DNA, 18 bp, synthetic construct
  source 1..18: mol_type = other DNA
ttatccgactcaatttcg

SEQ ID NO: 63604 - DNA, 18 bp, synthetic construct
  source 1..18: mol_type = other DNA
ttatccgcctccgttcag

SEQ ID NO: 63605 - DNA, 18 bp, synthetic construct
  source 1..18: mol_type = other DNA
ttatccgcctgagtatag

SEQ ID NO: 63606 - DNA, 18 bp, synthetic construct
  source 1..18: mol_type = other DNA
ttatccgcgtcaccaaag

SEQ ID NO: 63607 - DNA, 18 bp, synthetic construct
  source 1..18: mol_type = other DNA
ttatcctcctcatcattg

SEQ ID NO: 63608 - DNA, 18 bp, synthetic construct
  source 1..18: mol_type = other DNA
ttatctgaatcactatcg

SEQ ID NO: 63609 - DNA, 18 bp, synthetic construct
  source 1..18: mol_type = other DNA
ttatcttattcactattg

SEQ ID NO: 63610 - DNA, 18 bp, synthetic construct
  source 1..18: mol_type = other DNA
ttatgaatcttaccattg

SEQ ID NO: 63611 - DNA, 18 bp, synthetic construct
  source 1..18: mol_type = other DNA
ttatgagactctttatag

SEQ ID NO: 63612 - DNA, 18 bp, synthetic construct
  source 1..18: mol_type = other DNA
ttatgcaacacagtatag

SEQ ID NO: 63613 - DNA, 18 bp, synthetic construct
  source 1..18: mol_type = other DNA
ttatgcgactcgcaactg

SEQ ID NO: 63614 - DNA, 18 bp, synthetic construct
  source 1..18: mol_type = other DNA
ttatgcgactctaaatag

SEQ ID NO: 63615 - DNA, 18 bp, synthetic construct
  source 1..18: mol_type = other DNA
ttatgcgacttacttttg

SEQ ID NO: 63616 - DNA, 18 bp, synthetic construct
  source 1..18: mol_type = other DNA
ttatgcgattcataatag

SEQ ID NO: 63617 - DNA, 18 bp, synthetic construct
  source 1..18: mol_type = other DNA
ttatgcggctttctaatg

SEQ ID NO: 63618 - DNA, 18 bp, synthetic construct
  source 1..18: mol_type = other DNA
ttatgcgtatcactaaag

SEQ ID NO: 63619 - DNA, 18 bp, synthetic construct
  source 1..18: mol_type = other DNA
ttatgcgtcaatctttag

SEQ ID NO: 63620 - DNA, 18 bp, synthetic construct
  source 1..18: mol_type = other DNA
ttatgctatgcaccttag

SEQ ID NO: 63621 - DNA, 18 bp, synthetic construct
  source 1..18: mol_type = other DNA
ttatgcttctctctatag

SEQ ID NO: 63622 - DNA, 18 bp, synthetic construct
  source 1..18: mol_type = other DNA
ttatgtgactcgctattg

SEQ ID NO: 63623 - DNA, 18 bp, synthetic construct
  source 1..18: mol_type = other DNA
ttattagaatcactaaag

SEQ ID NO: 63624 - DNA, 18 bp, synthetic construct
  source 1..18: mol_type = other DNA
ttattagacccactaatg

SEQ ID NO: 63625 - DNA, 18 bp, synthetic construct
  source 1..18: mol_type = other DNA
ttattagagtcatgaaag

SEQ ID NO: 63626 - DNA, 18 bp, synthetic construct
  source 1..18: mol_type = other DNA
ttattagcctcactaaag

SEQ ID NO: 63627 - DNA, 18 bp, synthetic construct
  source 1..18: mol_type = other DNA
ttattattctctctatag

SEQ ID NO: 63628 - DNA, 18 bp, synthetic construct
  source 1..18: mol_type = other DNA
ttattcaattcacaattg

SEQ ID NO: 63629 - DNA, 18 bp, synthetic construct
  source 1..18: mol_type = other DNA
ttattcacctgactatag

SEQ ID NO: 63630 - DNA, 18 bp, synthetic construct
  source 1..18: mol_type = other DNA
ttattccactcattagtg

SEQ ID NO: 63631 - DNA, 18 bp, synthetic construct
  source 1..18: mol_type = other DNA
ttattccactcggtatag

SEQ ID NO: 63632 - DNA, 18 bp, synthetic construct
  source 1..18: mol_type = other DNA
ttattccacttacaatag

SEQ ID NO: 63633 - DNA, 18 bp, synthetic construct
  source 1..18: mol_type = other DNA
ttattccagtcaccattg

SEQ ID NO: 63634 - DNA, 18 bp, synthetic construct
  source 1..18: mol_type = other DNA
ttattcgaaacattatag

SEQ ID NO: 63635 - DNA, 18 bp, synthetic construct
  source 1..18: mol_type = other DNA
ttattcgacaccctattg

SEQ ID NO: 63636 - DNA, 18 bp, synthetic construct
  source 1..18: mol_type = other DNA
ttattcgactcatattag

SEQ ID NO: 63637 - DNA, 18 bp, synthetic construct
  source 1..18: mol_type = other DNA
ttattcgactcgatattg

SEQ ID NO: 63638 - DNA, 18 bp, synthetic construct
  source 1..18: mol_type = other DNA
ttattcgagcctctccaa

SEQ ID NO: 63639 - DNA, 18 bp, synthetic construct
  source 1..18: mol_type = other DNA
ttattcgatacacaatag

SEQ ID NO: 63640 - DNA, 18 bp, synthetic construct
  source 1..18: mol_type = other DNA
ttattcgattcataaatg

SEQ ID NO: 63641 - DNA, 18 bp, synthetic construct
  source 1..18: mol_type = other DNA
ttattcgattcgttttag

SEQ ID NO: 63642 - DNA, 18 bp, synthetic construct
  source 1..18: mol_type = other DNA
ttattcgcctcaattgtg

SEQ ID NO: 63643 - DNA, 18 bp, synthetic construct
  source 1..18: mol_type = other DNA
ttattcgtataaatattg

SEQ ID NO: 63644 - DNA, 18 bp, synthetic construct
  source 1..18: mol_type = other DNA
ttattcgtatcaatattg

SEQ ID NO: 63645 - DNA, 18 bp, synthetic construct
  source 1..18: mol_type = other DNA
ttattcgtccaagtatag

SEQ ID NO: 63646 - DNA, 18 bp, synthetic construct
  source 1..18: mol_type = other DNA
ttattcgtcccactacag

SEQ ID NO: 63647 - DNA, 18 bp, synthetic construct
  source 1..18: mol_type = other DNA
ttattcgtctatctaaag

SEQ ID NO: 63648 - DNA, 18 bp, synthetic construct
  source 1..18: mol_type = other DNA
ttattcgtctcatcttag

SEQ ID NO: 63649 - DNA, 18 bp, synthetic construct
  source 1..18: mol_type = other DNA
ttattcgtttcactagag

SEQ ID NO: 63650 - DNA, 18 bp, synthetic construct
  source 1..18: mol_type = other DNA
ttattctacacaatattg

SEQ ID NO: 63651 - DNA, 18 bp, synthetic construct
  source 1..18: mol_type = other DNA
ttattctacgcaatattg

SEQ ID NO: 63652 - DNA, 18 bp, synthetic construct
  source 1..18: mol_type = other DNA
ttattctactaactaaag

SEQ ID NO: 63653 - DNA, 18 bp, synthetic construct
  source 1..18: mol_type = other DNA
ttattctagacactaaag

SEQ ID NO: 63654 - DNA, 18 bp, synthetic construct
  source 1..18: mol_type = other DNA
ttattctatacgcaattg

SEQ ID NO: 63655 - DNA, 18 bp, synthetic construct
  source 1..18: mol_type = other DNA
ttattctcctcactattg

SEQ ID NO: 63656 - DNA, 18 bp, synthetic construct
  source 1..18: mol_type = other DNA
ttattcttctaattttag

SEQ ID NO: 63657 - DNA, 18 bp, synthetic construct
  source 1..18: mol_type = other DNA
ttattggacttattatag

SEQ ID NO: 63658 - DNA, 18 bp, synthetic construct
  source 1..18: mol_type = other DNA
ttatttcaatcactacag

SEQ ID NO: 63659 - DNA, 18 bp, synthetic construct
  source 1..18: mol_type = other DNA
ttatttgaatagctttag

SEQ ID NO: 63660 - DNA, 18 bp, synthetic construct
  source 1..18: mol_type = other DNA
ttatttgacccactattg

SEQ ID NO: 63661 - DNA, 18 bp, synthetic construct
  source 1..18: mol_type = other DNA
ttatttgtcttactatag

SEQ ID NO: 63662 - DNA, 18 bp, synthetic construct
  source 1..18: mol_type = other DNA
ttatttttctcactatag

SEQ ID NO: 63663 - DNA, 18 bp, synthetic construct
  source 1..18: mol_type = other DNA
ttcaacgacacactacag

SEQ ID NO: 63664 - DNA, 18 bp, synthetic construct
  source 1..18: mol_type = other DNA
ttcatcgtcactcttctg

SEQ ID NO: 63665 - DNA, 18 bp, synthetic construct
  source 1..18: mol_type = other DNA
ttcattggctcactatag

SEQ ID NO: 63666 - DNA, 18 bp, synthetic construct
  source 1..18: mol_type = other DNA
ttccggtaccttctacag

SEQ ID NO: 63667 - DNA, 18 bp, synthetic construct
  source 1..18: mol_type = other DNA
ttctaatactcactagag

SEQ ID NO: 63668 - DNA, 18 bp, synthetic construct
  source 1..18: mol_type = other DNA
ttctacaactaactttag

SEQ ID NO: 63669 - DNA, 18 bp, synthetic construct
  source 1..18: mol_type = other DNA
ttctaccccacactaagg

SEQ ID NO: 63670 - DNA, 18 bp, synthetic construct
  source 1..18: mol_type = other DNA
ttctacgaaactcaatag

SEQ ID NO: 63671 - DNA, 18 bp, synthetic construct
  source 1..18: mol_type = other DNA
ttctacgacaaccaatag

SEQ ID NO: 63672 - DNA, 18 bp, synthetic construct
  source 1..18: mol_type = other DNA
ttctacgactctgaatag

SEQ ID NO: 63673 - DNA, 18 bp, synthetic construct
  source 1..18: mol_type = other DNA
ttctacgatccacattag

SEQ ID NO: 63674 - DNA, 18 bp, synthetic construct
  source 1..18: mol_type = other DNA
ttctacgattctctaacg

SEQ ID NO: 63675 - DNA, 18 bp, synthetic construct
  source 1..18: mol_type = other DNA
ttctaggacttcctacag

SEQ ID NO: 63676 - DNA, 18 bp, synthetic construct
  source 1..18: mol_type = other DNA
ttctgcgtctcactttag

SEQ ID NO: 63677 - DNA, 18 bp, synthetic construct
  source 1..18: mol_type = other DNA
ttcttcgtctaacattag

SEQ ID NO: 63678 - DNA, 18 bp, synthetic construct
  source 1..18: mol_type = other DNA
ttcttcgtcttactatag

SEQ ID NO: 63679 - DNA, 18 bp, synthetic construct
  source 1..18: mol_type = other DNA
ttcttggtctccacatag

SEQ ID NO: 63680 - DNA, 18 bp, synthetic construct
  source 1..18: mol_type = other DNA
ttgaacgacactctattg

SEQ ID NO: 63681 - DNA, 18 bp, synthetic construct
  source 1..18: mol_type = other DNA
ttgaacgactcacttttg

SEQ ID NO: 63682 - DNA, 18 bp, synthetic construct
  source 1..18: mol_type = other DNA
ttgaacgactccctacag

SEQ ID NO: 63683 - DNA, 18 bp, synthetic construct
  source 1..18: mol_type = other DNA
ttgaacgactctctacag

SEQ ID NO: 63684 - DNA, 18 bp, synthetic construct
  source 1..18: mol_type = other DNA
ttgaacgctactctatag

SEQ ID NO: 63685 - DNA, 18 bp, synthetic construct
  source 1..18: mol_type = other DNA
ttgagcgactgtctactg

SEQ ID NO: 63686 - DNA, 18 bp, synthetic construct
  source 1..18: mol_type = other DNA
ttgatcgtctcattatag

SEQ ID NO: 63687 - DNA, 18 bp, synthetic construct
  source 1..18: mol_type = other DNA
ttgcacgtttctcaatag

SEQ ID NO: 63688 - DNA, 18 bp, synthetic construct
  source 1..18: mol_type = other DNA
ttgtaagtttcaatatag

SEQ ID NO: 63689 - DNA, 18 bp, synthetic construct
  source 1..18: mol_type = other DNA
ttgtacccctcgctttag

SEQ ID NO: 63690 - DNA, 18 bp, synthetic construct
  source 1..18: mol_type = other DNA
ttgtacgacactctaaag

SEQ ID NO: 63691 - DNA, 18 bp, synthetic construct
  source 1..18: mol_type = other DNA
ttgtacgactcacaccag

SEQ ID NO: 63692 - DNA, 18 bp, synthetic construct
  source 1..18: mol_type = other DNA
ttgtacgactcgatttag

SEQ ID NO: 63693 - DNA, 18 bp, synthetic construct
  source 1..18: mol_type = other DNA
ttgtacgactgaattgag

SEQ ID NO: 63694 - DNA, 18 bp, synthetic construct
  source 1..18: mol_type = other DNA
ttgtacgacttacttttg

SEQ ID NO: 63695 - DNA, 18 bp, synthetic construct
  source 1..18: mol_type = other DNA
ttgtacgacttagtagag

SEQ ID NO: 63696 - DNA, 18 bp, synthetic construct
  source 1..18: mol_type = other DNA
ttgtacgatgcacagttg

SEQ ID NO: 63697 - DNA, 18 bp, synthetic construct
  source 1..18: mol_type = other DNA
ttgtacgccacataatag

SEQ ID NO: 63698 - DNA, 18 bp, synthetic construct
  source 1..18: mol_type = other DNA
ttgtacgtctcataattg

SEQ ID NO: 63699 - DNA, 18 bp, synthetic construct
  source 1..18: mol_type = other DNA
ttgtactactaactgtag

SEQ ID NO: 63700 - DNA, 18 bp, synthetic construct
  source 1..18: mol_type = other DNA
ttgtagcgctctatgtag

SEQ ID NO: 63701 - DNA, 18 bp, synthetic construct
  source 1..18: mol_type = other DNA
ttgtatcattcactcttg

SEQ ID NO: 63702 - DNA, 18 bp, synthetic construct
  source 1..18: mol_type = other DNA
ttgtccgactcactttcg

SEQ ID NO: 63703 - DNA, 18 bp, synthetic construct
  source 1..18: mol_type = other DNA
ttgtccggctcacaatcg

SEQ ID NO: 63704 - DNA, 18 bp, synthetic construct
  source 1..18: mol_type = other DNA
ttgtccgttccactatag

SEQ ID NO: 63705 - DNA, 18 bp, synthetic construct
  source 1..18: mol_type = other DNA
ttgttcgactcacataag

SEQ ID NO: 63706 - DNA, 18 bp, synthetic construct
  source 1..18: mol_type = other DNA
ttgttcgtctcaggcatg

SEQ ID NO: 63707 - DNA, 18 bp, synthetic construct
  source 1..18: mol_type = other DNA
ttgtttggctctcataag

SEQ ID NO: 63708 - DNA, 18 bp, synthetic construct
  source 1..18: mol_type = other DNA
tttaaaaactaactatag

SEQ ID NO: 63709 - DNA, 18 bp, synthetic construct
  source 1..18: mol_type = other DNA
tttaaagactcattatag

SEQ ID NO: 63710 - DNA, 18 bp, synthetic construct
  source 1..18: mol_type = other DNA
tttaaatactcacttttg

SEQ ID NO: 63711 - DNA, 18 bp, synthetic construct
  source 1..18: mol_type = other DNA
tttaacaaatcccaatag

SEQ ID NO: 63712 - DNA, 18 bp, synthetic construct
  source 1..18: mol_type = other DNA
tttaacaactcagtaaag

SEQ ID NO: 63713 - DNA, 18 bp, synthetic construct
  source 1..18: mol_type = other DNA
tttaacaactgactatag

SEQ ID NO: 63714 - DNA, 18 bp, synthetic construct
  source 1..18: mol_type = other DNA
tttaacgactcatgattg

SEQ ID NO: 63715 - DNA, 18 bp, synthetic construct
  source 1..18: mol_type = other DNA
tttaacgttttacaacgg

SEQ ID NO: 63716 - DNA, 18 bp, synthetic construct
  source 1..18: mol_type = other DNA
tttaaggactaactatag

SEQ ID NO: 63717 - DNA, 18 bp, synthetic construct
  source 1..18: mol_type = other DNA
tttaagtactctctgtcg

SEQ ID NO: 63718 - DNA, 18 bp, synthetic construct
  source 1..18: mol_type = other DNA
tttaatgacagactatgg

SEQ ID NO: 63719 - DNA, 18 bp, synthetic construct
  source 1..18: mol_type = other DNA
tttaatgactctctatcg

SEQ ID NO: 63720 - DNA, 18 bp, synthetic construct
  source 1..18: mol_type = other DNA
tttaattacacgctattg

SEQ ID NO: 63721 - DNA, 18 bp, synthetic construct
  source 1..18: mol_type = other DNA
tttaccgactcgctatag

SEQ ID NO: 63722 - DNA, 18 bp, synthetic construct
  source 1..18: mol_type = other DNA
tttaccgtttcacagtag

SEQ ID NO: 63723 - DNA, 18 bp, synthetic construct
  source 1..18: mol_type = other DNA
tttagcaactcacttcag

SEQ ID NO: 63724 - DNA, 18 bp, synthetic construct
  source 1..18: mol_type = other DNA
tttcaagcctctctaaag

SEQ ID NO: 63725 - DNA, 18 bp, synthetic construct
  source 1..18: mol_type = other DNA
tttcacgaatttcttcag

SEQ ID NO: 63726 - DNA, 18 bp, synthetic construct
  source 1..18: mol_type = other DNA
tttcacgagtcataatag

SEQ ID NO: 63727 - DNA, 18 bp, synthetic construct
  source 1..18: mol_type = other DNA
tttcacgattcaatatcg

SEQ ID NO: 63728 - DNA, 18 bp, synthetic construct
  source 1..18: mol_type = other DNA
tttcacgattcattatag

SEQ ID NO: 63729 - DNA, 18 bp, synthetic construct
  source 1..18: mol_type = other DNA
tttcactactctccatag

SEQ ID NO: 63730 - DNA, 18 bp, synthetic construct
  source 1..18: mol_type = other DNA
tttcatgacacattatag

SEQ ID NO: 63731 - DNA, 18 bp, synthetic construct
  source 1..18: mol_type = other DNA
tttctaaaattacttcgg

SEQ ID NO: 63732 - DNA, 18 bp, synthetic construct
  source 1..18: mol_type = other DNA
tttctcaactctctcttg

SEQ ID NO: 63733 - DNA, 18 bp, synthetic construct
  source 1..18: mol_type = other DNA
tttctcgaatcactttag

SEQ ID NO: 63734 - DNA, 18 bp, synthetic construct
  source 1..18: mol_type = other DNA
tttgtagactcacattgg

SEQ ID NO: 63735 - DNA, 18 bp, synthetic construct
  source 1..18: mol_type = other DNA
ttttaagacacattatag

SEQ ID NO: 63736 - DNA, 18 bp, synthetic construct
  source 1..18: mol_type = other DNA
ttttaagactagctacag

SEQ ID NO: 63737 - DNA, 18 bp, synthetic construct
  source 1..18: mol_type = other DNA
ttttaatactctgaattg

SEQ ID NO: 63738 - DNA, 18 bp, synthetic construct
  source 1..18: mol_type = other DNA
ttttacaactgattaaag

SEQ ID NO: 63739 - DNA, 18 bp, synthetic construct
  source 1..18: mol_type = other DNA
ttttacaagtctctatag

SEQ ID NO: 63740 - DNA, 18 bp, synthetic construct
  source 1..18: mol_type = other DNA
ttttacacctcactttag

SEQ ID NO: 63741 - DNA, 18 bp, synthetic construct
  source 1..18: mol_type = other DNA
ttttacatctgaatatag

SEQ ID NO: 63742 - DNA, 18 bp, synthetic construct
  source 1..18: mol_type = other DNA
ttttaccactctttatag

SEQ ID NO: 63743 - DNA, 18 bp, synthetic construct
  source 1..18: mol_type = other DNA
ttttaccagcctcaatag

SEQ ID NO: 63744 - DNA, 18 bp, synthetic construct
  source 1..18: mol_type = other DNA
ttttacgacacaacatag

SEQ ID NO: 63745 - DNA, 18 bp, synthetic construct
  source 1..18: mol_type = other DNA
ttttacgacactcaatag

SEQ ID NO: 63746 - DNA, 18 bp, synthetic construct
  source 1..18: mol_type = other DNA
ttttacgaccaaatatag

SEQ ID NO: 63747 - DNA, 18 bp, synthetic construct
  source 1..18: mol_type = other DNA
ttttacgacttacaaaag

SEQ ID NO: 63748 - DNA, 18 bp, synthetic construct
  source 1..18: mol_type = other DNA
ttttacgcctcacactag

SEQ ID NO: 63749 - DNA, 18 bp, synthetic construct
  source 1..18: mol_type = other DNA
ttttacgcctcacattag

SEQ ID NO: 63750 - DNA, 18 bp, synthetic construct
  source 1..18: mol_type = other DNA
ttttacggctaactactg

SEQ ID NO: 63751 - DNA, 18 bp, synthetic construct
  source 1..18: mol_type = other DNA
ttttacggctctttatag

SEQ ID NO: 63752 - DNA, 18 bp, synthetic construct
  source 1..18: mol_type = other DNA
ttttactcattccttttg

SEQ ID NO: 63753 - DNA, 18 bp, synthetic construct
  source 1..18: mol_type = other DNA
ttttacttgtcaccattg

SEQ ID NO: 63754 - DNA, 18 bp, synthetic construct
  source 1..18: mol_type = other DNA
ttttatgactcacattag

SEQ ID NO: 63755 - DNA, 18 bp, synthetic construct
  source 1..18: mol_type = other DNA
ttttatgactgactttag

SEQ ID NO: 63756 - DNA, 18 bp, synthetic construct
  source 1..18: mol_type = other DNA
ttttatgtctgaatgttg

SEQ ID NO: 63757 - DNA, 18 bp, synthetic construct
  source 1..18: mol_type = other DNA
ttttattactcactgtag

SEQ ID NO: 63758 - DNA, 18 bp, synthetic construct
  source 1..18: mol_type = other DNA
ttttatttaacatttttg

SEQ ID NO: 63759 - DNA, 18 bp, synthetic construct
  source 1..18: mol_type = other DNA
ttttccgacacactattg

SEQ ID NO: 63760 - DNA, 18 bp, synthetic construct
  source 1..18: mol_type = other DNA
ttttccttcgctaaaatg

SEQ ID NO: 63761 - DNA, 18 bp, synthetic construct
  source 1..18: mol_type = other DNA
ttttgagactaacaatag

SEQ ID NO: 63762 - DNA, 18 bp, synthetic construct
  source 1..18: mol_type = other DNA
ttttgcgaaacactatag

SEQ ID NO: 63763 - DNA, 18 bp, synthetic construct
  source 1..18: mol_type = other DNA
tttttcctcacactatcg

SEQ ID NO: 63764 - DNA, 18 bp, synthetic construct
  source 1..18: mol_type = other DNA
tttttcgacacactattg

SEQ ID NO: 63765 - DNA, 18 bp, synthetic construct
  source 1..18: mol_type = other DNA
tttttcgactcactgaag

SEQ ID NO: 63766 - DNA, 18 bp, synthetic construct
  source 1..18: mol_type = other DNA
tttttcgtctatctatag

SEQ ID NO: 63767 - DNA, 18 bp, synthetic construct
  source 1..18: mol_type = other DNA
tttttctacaaaattctg

SEQ ID NO: 63768 - DNA, 18 bp, synthetic construct
  source 1..18: mol_type = other DNA
taatcaggctccctattg

SEQ ID NO: 63769 - DNA, 18 bp, synthetic construct
  source 1..18: mol_type = other DNA
aaatgcgactcatatttg

SEQ ID NO: 63770 - DNA, 18 bp, synthetic construct
  source 1..18: mol_type = other DNA
aacacagtgtcactatag

SEQ ID NO: 63771 - DNA, 18 bp, synthetic construct
  source 1..18: mol_type = other DNA
aattagcacttactaatg

SEQ ID NO: 63772 - DNA, 18 bp, synthetic construct
  source 1..18: mol_type = other DNA
aatttctacccactatag

SEQ ID NO: 63773 - DNA, 18 bp, synthetic construct
  source 1..18: mol_type = other DNA
agataccatgcactattg

SEQ ID NO: 63774 - DNA, 18 bp, synthetic construct
  source 1..18: mol_type = other DNA
agattacactcactatag

SEQ ID NO: 63775 - DNA, 18 bp, synthetic construct
  source 1..18: mol_type = other DNA
atatacgacttaataaag

SEQ ID NO: 63776 - DNA, 18 bp, synthetic construct
  source 1..18: mol_type = other DNA
atatacgtcacatgatag

SEQ ID NO: 63777 - DNA, 18 bp, synthetic construct
  source 1..18: mol_type = other DNA
atttaccaaactttctgg

SEQ ID NO: 63778 - DNA, 18 bp, synthetic construct
  source 1..18: mol_type = other DNA
atttacgattctctattg

SEQ ID NO: 63779 - DNA, 18 bp, synthetic construct
  source 1..18: mol_type = other DNA
caatactactcaatgcag

SEQ ID NO: 63780 - DNA, 18 bp, synthetic construct
  source 1..18: mol_type = other DNA
caatcaaaccctttttag

SEQ ID NO: 63781 - DNA, 18 bp, synthetic construct
  source 1..18: mol_type = other DNA
cataataactcactatag

SEQ ID NO: 63782 - DNA, 18 bp, synthetic construct
  source 1..18: mol_type = other DNA
ctatgctagtcgcataag

SEQ ID NO: 63783 - DNA, 18 bp, synthetic construct
  source 1..18: mol_type = other DNA
taaaaagtctctttatag

SEQ ID NO: 63784 - DNA, 18 bp, synthetic construct
  source 1..18: mol_type = other DNA
taaacagtttcagtattg

SEQ ID NO: 63785 - DNA, 18 bp, synthetic construct
  source 1..18: mol_type = other DNA
taaagcaactgtctagag

SEQ ID NO: 63786 - DNA, 18 bp, synthetic construct
  source 1..18: mol_type = other DNA
taaatgttaccgctatag

SEQ ID NO: 63787 - DNA, 18 bp, synthetic construct
  source 1..18: mol_type = other DNA
taactcgtgtcactcaag

SEQ ID NO: 63788 - DNA, 18 bp, synthetic construct
  source 1..18: mol_type = other DNA
taagacgtctgactaatg

SEQ ID NO: 63789 - DNA, 18 bp, synthetic construct
  source 1..18: mol_type = other DNA
taatacgacattgtaaag

SEQ ID NO: 63790 - DNA, 18 bp, synthetic construct
  source 1..18: mol_type = other DNA
taatacgtaacactttgg

SEQ ID NO: 63791 - DNA, 18 bp, synthetic construct
  source 1..18: mol_type = other DNA
taatactattttctttag

SEQ ID NO: 63792 - DNA, 18 bp, synthetic construct
  source 1..18: mol_type = other DNA
taatatctctcattaaag

SEQ ID NO: 63793 - DNA, 18 bp, synthetic construct
  source 1..18: mol_type = other DNA
taatatgtctctataacg

SEQ ID NO: 63794 - DNA, 18 bp, synthetic construct
  source 1..18: mol_type = other DNA
taatctgatccgatatag

SEQ ID NO: 63795 - DNA, 18 bp, synthetic construct
  source 1..18: mol_type = other DNA
taatgcaactatccatag

SEQ ID NO: 63796 - DNA, 18 bp, synthetic construct
  source 1..18: mol_type = other DNA
taatgcatctaactgttg

SEQ ID NO: 63797 - DNA, 18 bp, synthetic construct
  source 1..18: mol_type = other DNA
taattcaacgaaatctag

SEQ ID NO: 63798 - DNA, 18 bp, synthetic construct
  source 1..18: mol_type = other DNA
taatttttcttactatag

SEQ ID NO: 63799 - DNA, 18 bp, synthetic construct
  source 1..18: mol_type = other DNA
tacaacgaaccagtttag

SEQ ID NO: 63800 - DNA, 18 bp, synthetic construct
  source 1..18: mol_type = other DNA
tacttcgacactctattg

SEQ ID NO: 63801 - DNA, 18 bp, synthetic construct
  source 1..18: mol_type = other DNA
tataacgacacactaacg

SEQ ID NO: 63802 - DNA, 18 bp, synthetic construct
  source 1..18: mol_type = other DNA
tataatgacgtataatag

SEQ ID NO: 63803 - DNA, 18 bp, synthetic construct
  source 1..18: mol_type = other DNA
tatatccacacactatag

SEQ ID NO: 63804 - DNA, 18 bp, synthetic construct
  source 1..18: mol_type = other DNA
tatatcgacaaactatag

SEQ ID NO: 63805 - DNA, 18 bp, synthetic construct
  source 1..18: mol_type = other DNA
tatatcgactgactctag

SEQ ID NO: 63806 - DNA, 18 bp, synthetic construct
  source 1..18: mol_type = other DNA
tatctcgaattactattg

SEQ ID NO: 63807 - DNA, 18 bp, synthetic construct
  source 1..18: mol_type = other DNA
tattacaaatcaatatcg

SEQ ID NO: 63808 - DNA, 18 bp, synthetic construct
  source 1..18: mol_type = other DNA
tattacatctcagtatcg

SEQ ID NO: 63809 - DNA, 18 bp, synthetic construct
  source 1..18: mol_type = other DNA
tattacgactccttctcg

SEQ ID NO: 63810 - DNA, 18 bp, synthetic construct
  source 1..18: mol_type = other DNA
tatttctacttaatatag

SEQ ID NO: 63811 - DNA, 18 bp, synthetic construct
  source 1..18: mol_type = other DNA
tcacatgacacactaaag

SEQ ID NO: 63812 - DNA, 18 bp, synthetic construct
  source 1..18: mol_type = other DNA
tcatacgatccacaattg

SEQ ID NO: 63813 - DNA, 18 bp, synthetic construct
  source 1..18: mol_type = other DNA
tcgtactactcacaattg

SEQ ID NO: 63814 - DNA, 18 bp, synthetic construct
  source 1..18: mol_type = other DNA
tgatactagtttctatag

SEQ ID NO: 63815 - DNA, 18 bp, synthetic construct
  source 1..18: mol_type = other DNA
tgatccgccacacaatag

SEQ ID NO: 63816 - DNA, 18 bp, synthetic construct
  source 1..18: mol_type = other DNA
ttacttgtctcactatag

SEQ ID NO: 63817 - DNA, 18 bp, synthetic construct
  source 1..18: mol_type = other DNA
ttatacgaaccaccttag

SEQ ID NO: 63818 - DNA, 18 bp, synthetic construct
  source 1..18: mol_type = other DNA
ttatacgacatgaaatag

SEQ ID NO: 63819 - DNA, 18 bp, synthetic construct
  source 1..18: mol_type = other DNA
ttatacgattctcttttg

SEQ ID NO: 63820 - DNA, 18 bp, synthetic construct
  source 1..18: mol_type = other DNA
ttatacgtgtaattattg

SEQ ID NO: 63821 - DNA, 18 bp, synthetic construct
  source 1..18: mol_type = other DNA
ttatatgacaaactacag

SEQ ID NO: 63822 - DNA, 18 bp, synthetic construct
  source 1..18: mol_type = other DNA
ttcaacgtctctctatag

SEQ ID NO: 63823 - DNA, 18 bp, synthetic construct
  source 1..18: mol_type = other DNA
ttttttcactcactttag

SEQ ID NO: 63824 - DNA, 18 bp, synthetic construct
  source 1..18: mol_type = other DNA
ttttcctactcactttag

SEQ ID NO: 63825 - DNA, 18 bp, synthetic construct
  source 1..18: mol_type = other DNA
tataactactcattattg

SEQ ID NO: 63826 - DNA, 18 bp, synthetic construct
  source 1..18: mol_type = other DNA
attaacgactcaaaaaag

SEQ ID NO: 63827 - DNA, 18 bp, synthetic construct
  source 1..18: mol_type = other DNA
ctatacgtctcacaaaag

SEQ ID NO: 63828 - DNA, 18 bp, synthetic construct
  source 1..18: mol_type = other DNA
taattcgaatctcttcag

SEQ ID NO: 63829 - DNA, 18 bp, synthetic construct
  source 1..18: mol_type = other DNA
tcttatctctcactatag

SEQ ID NO: 63830 - DNA, 18 bp, synthetic construct
  source 1..18: mol_type = other DNA
ttatacgtctctcaaaag

SEQ ID NO: 63831 - DNA, 18 bp, synthetic construct
  source 1..18: mol_type = other DNA
aaacccgccgcagtatag

SEQ ID NO: 63832 - DNA, 18 bp, synthetic construct
  source 1..18: mol_type = other DNA
aaatacgattctctaatg

SEQ ID NO: 63833 - DNA, 18 bp, synthetic construct
  source 1..18: mol_type = other DNA
aaatacgcctctgtatcg

SEQ ID NO: 63834 - DNA, 18 bp, synthetic construct
  source 1..18: mol_type = other DNA
aaatatatctcactttag

SEQ ID NO: 63835 - DNA, 18 bp, synthetic construct
  source 1..18: mol_type = other DNA
aaattcgactcgcttttg

SEQ ID NO: 63836 - DNA, 18 bp, synthetic construct
  source 1..18: mol_type = other DNA
aagtccaactcactgtag

SEQ ID NO: 63837 - DNA, 18 bp, synthetic construct
  source 1..18: mol_type = other DNA
aatttcgactctttatag

SEQ ID NO: 63838 - DNA, 18 bp, synthetic construct
  source 1..18: mol_type = other DNA
acattcgactcttaatag

SEQ ID NO: 63839 - DNA, 18 bp, synthetic construct
  source 1..18: mol_type = other DNA
atatccgactcgctcaag

SEQ ID NO: 63840 - DNA, 18 bp, synthetic construct
  source 1..18: mol_type = other DNA
atattcgacacactttag

SEQ ID NO: 63841 - DNA, 18 bp, synthetic construct
  source 1..18: mol_type = other DNA
atgtaccactgactatag

SEQ ID NO: 63842 - DNA, 18 bp, synthetic construct
  source 1..18: mol_type = other DNA
caatacgacactactaag

SEQ ID NO: 63843 - DNA, 18 bp, synthetic construct
  source 1..18: mol_type = other DNA
caatacgtcgagctattg

SEQ ID NO: 63844 - DNA, 18 bp, synthetic construct
  source 1..18: mol_type = other DNA
caatgcgtctctctattg

SEQ ID NO: 63845 - DNA, 18 bp, synthetic construct
  source 1..18: mol_type = other DNA
ccgaataagtcactatag

SEQ ID NO: 63846 - DNA, 18 bp, synthetic construct
  source 1..18: mol_type = other DNA
ctttaagactcattaaag

SEQ ID NO: 63847 - DNA, 18 bp, synthetic construct
  source 1..18: mol_type = other DNA
taaaacgatacacactag

SEQ ID NO: 63848 - DNA, 18 bp, synthetic construct
  source 1..18: mol_type = other DNA
taacacgtctctcttttg

SEQ ID NO: 63849 - DNA, 18 bp, synthetic construct
  source 1..18: mol_type = other DNA
taataccaattaatttag

SEQ ID NO: 63850 - DNA, 18 bp, synthetic construct
  source 1..18: mol_type = other DNA
taatacgtttttctcttg

SEQ ID NO: 63851 - DNA, 18 bp, synthetic construct
  source 1..18: mol_type = other DNA
taatgcgtaccagttaag

SEQ ID NO: 63852 - DNA, 18 bp, synthetic construct
  source 1..18: mol_type = other DNA
taattctagtcactaatg

SEQ ID NO: 63853 - DNA, 18 bp, synthetic construct
  source 1..18: mol_type = other DNA
taatttgtctctatatag

SEQ ID NO: 63854 - DNA, 18 bp, synthetic construct
  source 1..18: mol_type = other DNA
taattttactctctttag

SEQ ID NO: 63855 - DNA, 18 bp, synthetic construct
  source 1..18: mol_type = other DNA
tagtacgtcttacaacag

SEQ ID NO: 63856 - DNA, 18 bp, synthetic construct
  source 1..18: mol_type = other DNA
tataacatctcactttag

SEQ ID NO: 63857 - DNA, 18 bp, synthetic construct
  source 1..18: mol_type = other DNA
tatagggactctcaatag

SEQ ID NO: 63858 - DNA, 18 bp, synthetic construct
  source 1..18: mol_type = other DNA
tatatctactaactatag

SEQ ID NO: 63859 - DNA, 18 bp, synthetic construct
  source 1..18: mol_type = other DNA
tatgtcggcccactaatg

SEQ ID NO: 63860 - DNA, 18 bp, synthetic construct
  source 1..18: mol_type = other DNA
tattacgtcacactttcg

SEQ ID NO: 63861 - DNA, 18 bp, synthetic construct
  source 1..18: mol_type = other DNA
tcaaccgactctctattg

SEQ ID NO: 63862 - DNA, 18 bp, synthetic construct
  source 1..18: mol_type = other DNA
tcataacgacaactcttg

SEQ ID NO: 63863 - DNA, 18 bp, synthetic construct
  source 1..18: mol_type = other DNA
tcttacgacatactttag

SEQ ID NO: 63864 - DNA, 18 bp, synthetic construct
  source 1..18: mol_type = other DNA
tctttcgactcactttcg

SEQ ID NO: 63865 - DNA, 18 bp, synthetic construct
  source 1..18: mol_type = other DNA
tgatacgtcccattaaag

SEQ ID NO: 63866 - DNA, 18 bp, synthetic construct
  source 1..18: mol_type = other DNA
tgttacgactcacataag

SEQ ID NO: 63867 - DNA, 18 bp, synthetic construct
  source 1..18: mol_type = other DNA
tgttacgattctctattg

SEQ ID NO: 63868 - DNA, 18 bp, synthetic construct
  source 1..18: mol_type = other DNA
ttaaacgtctaactatgg

SEQ ID NO: 63869 - DNA, 18 bp, synthetic construct
  source 1..18: mol_type = other DNA
ttagacttctccctatag

SEQ ID NO: 63870 - DNA, 18 bp, synthetic construct
  source 1..18: mol_type = other DNA
ttataccattcagtgtag

SEQ ID NO: 63871 - DNA, 18 bp, synthetic construct
  source 1..18: mol_type = other DNA
ttatacgtcgcacatttg

SEQ ID NO: 63872 - DNA, 18 bp, synthetic construct
  source 1..18: mol_type = other DNA
ttatactaatcactaatg

SEQ ID NO: 63873 - DNA, 18 bp, synthetic construct
  source 1..18: mol_type = other DNA
ttattcaacttaccatag

SEQ ID NO: 63874 - DNA, 18 bp, synthetic construct
  source 1..18: mol_type = other DNA
ttattcgactatcgatag

SEQ ID NO: 63875 - DNA, 18 bp, synthetic construct
  source 1..18: mol_type = other DNA
ttattcgactcaactttg

SEQ ID NO: 63876 - DNA, 18 bp, synthetic construct
  source 1..18: mol_type = other DNA
ttattcgactcacaaatg

SEQ ID NO: 63877 - DNA, 18 bp, synthetic construct
  source 1..18: mol_type = other DNA
ttcgactacttactttag

SEQ ID NO: 63878 - DNA, 18 bp, synthetic construct
  source 1..18: mol_type = other DNA
ttctaagaatcactaaag

SEQ ID NO: 63879 - DNA, 18 bp, synthetic construct
  source 1..18: mol_type = other DNA
ttgtacgagtctctgtcg

SEQ ID NO: 63880 - DNA, 18 bp, synthetic construct
  source 1..18: mol_type = other DNA
tttatcaactctctatag

SEQ ID NO: 63881 - DNA, 18 bp, synthetic construct
  source 1..18: mol_type = other DNA
tttctcgactctctatag

SEQ ID NO: 63882 - DNA, 18 bp, synthetic construct
  source 1..18: mol_type = other DNA
ttttacgactcacaactg

SEQ ID NO: 63883 - DNA, 18 bp, synthetic construct
  source 1..18: mol_type = other DNA
ttttacgttccactaaag

SEQ ID NO: 63884 - DNA, 18 bp, synthetic construct
  source 1..18: mol_type = other DNA
ttttacgtttctctatag

SEQ ID NO: 63885 - DNA, 18 bp, synthetic construct
  source 1..18: mol_type = other DNA
aaaaaagatttactatag

SEQ ID NO: 63886 - DNA, 18 bp, synthetic construct
  source 1..18: mol_type = other DNA
aaaaacgaccctcaaaag

SEQ ID NO: 63887 - DNA, 18 bp, synthetic construct
  source 1..18: mol_type = other DNA
aaaaacgactctcttgag

SEQ ID NO: 63888 - DNA, 18 bp, synthetic construct
  source 1..18: mol_type = other DNA
aaaaacgattctcaaaag

SEQ ID NO: 63889 - DNA, 18 bp, synthetic construct
  source 1..18: mol_type = other DNA
aaaaactacactctattg

SEQ ID NO: 63890 - DNA, 18 bp, synthetic construct
  source 1..18: mol_type = other DNA
aaaaatcactctctatag

SEQ ID NO: 63891 - DNA, 18 bp, synthetic construct
  source 1..18: mol_type = other DNA
aaaacacactcactatag

SEQ ID NO: 63892 - DNA, 18 bp, synthetic construct
  source 1..18: mol_type = other DNA
aaaacagtcttactatag

SEQ ID NO: 63893 - DNA, 18 bp, synthetic construct
  source 1..18: mol_type = other DNA
aaaaccgattcactcttg

SEQ ID NO: 63894 - DNA, 18 bp, synthetic construct
  source 1..18: mol_type = other DNA
aaaactgactaactttag

SEQ ID NO: 63895 - DNA, 18 bp, synthetic construct
  source 1..18: mol_type = other DNA
aaaagcaacacactatag

SEQ ID NO: 63896 - DNA, 18 bp, synthetic construct
  source 1..18: mol_type = other DNA
aaaagcgactctctaaag

SEQ ID NO: 63897 - DNA, 18 bp, synthetic construct
  source 1..18: mol_type = other DNA
aaaatcaaatctctatag

SEQ ID NO: 63898 - DNA, 18 bp, synthetic construct
  source 1..18: mol_type = other DNA
aaaatcgtctaactttag

SEQ ID NO: 63899 - DNA, 18 bp, synthetic construct
  source 1..18: mol_type = other DNA
aaacacaattcaatgttg

SEQ ID NO: 63900 - DNA, 18 bp, synthetic construct
  source 1..18: mol_type = other DNA
aaacacatcacactacag

SEQ ID NO: 63901 - DNA, 18 bp, synthetic construct
  source 1..18: mol_type = other DNA
aaacacgtaatacaattg

SEQ ID NO: 63902 - DNA, 18 bp, synthetic construct
  source 1..18: mol_type = other DNA
aaacacgtctaagaattg

SEQ ID NO: 63903 - DNA, 18 bp, synthetic construct
  source 1..18: mol_type = other DNA
aaacacgtttcactacag

SEQ ID NO: 63904 - DNA, 18 bp, synthetic construct
  source 1..18: mol_type = other DNA
aaacagaactcgctattg

SEQ ID NO: 63905 - DNA, 18 bp, synthetic construct
  source 1..18: mol_type = other DNA
aaacaggcctcactaaag

SEQ ID NO: 63906 - DNA, 18 bp, synthetic construct
  source 1..18: mol_type = other DNA
aaacatgcatcatttaag

SEQ ID NO: 63907 - DNA, 18 bp, synthetic construct
  source 1..18: mol_type = other DNA
aaaccctaatcacttttg

SEQ ID NO: 63908 - DNA, 18 bp, synthetic construct
  source 1..18: mol_type = other DNA
aaactcgacacaatttag

SEQ ID NO: 63909 - DNA, 18 bp, synthetic construct
  source 1..18: mol_type = other DNA
aaactcgactcaacattg

SEQ ID NO: 63910 - DNA, 18 bp, synthetic construct
  source 1..18: mol_type = other DNA
aaactgtactcacaatgg

SEQ ID NO: 63911 - DNA, 18 bp, synthetic construct
  source 1..18: mol_type = other DNA
aaactttactcgcattag

SEQ ID NO: 63912 - DNA, 18 bp, synthetic construct
  source 1..18: mol_type = other DNA
aaagacgaacctctatag

SEQ ID NO: 63913 - DNA, 18 bp, synthetic construct
  source 1..18: mol_type = other DNA
aaagacgagtcacaattg

SEQ ID NO: 63914 - DNA, 18 bp, synthetic construct
  source 1..18: mol_type = other DNA
aaagacgatttagttaag

SEQ ID NO: 63915 - DNA, 18 bp, synthetic construct
  source 1..18: mol_type = other DNA
aaagactaatctcgtttg

SEQ ID NO: 63916 - DNA, 18 bp, synthetic construct
  source 1..18: mol_type = other DNA
aaagactattcaatatag

SEQ ID NO: 63917 - DNA, 18 bp, synthetic construct
  source 1..18: mol_type = other DNA
aaagtagactatctaaag

SEQ ID NO: 63918 - DNA, 18 bp, synthetic construct
  source 1..18: mol_type = other DNA
aaataaaactcattattg

SEQ ID NO: 63919 - DNA, 18 bp, synthetic construct
  source 1..18: mol_type = other DNA
aaataagacacataatcg

SEQ ID NO: 63920 - DNA, 18 bp, synthetic construct
  source 1..18: mol_type = other DNA
aaataagactcaagaaag

SEQ ID NO: 63921 - DNA, 18 bp, synthetic construct
  source 1..18: mol_type = other DNA
aaataagattcacttaag

SEQ ID NO: 63922 - DNA, 18 bp, synthetic construct
  source 1..18: mol_type = other DNA
aaataagtatcactattg

SEQ ID NO: 63923 - DNA, 18 bp, synthetic construct
  source 1..18: mol_type = other DNA
aaataatacttactttag

SEQ ID NO: 63924 - DNA, 18 bp, synthetic construct
  source 1..18: mol_type = other DNA
aaataatatacattattg

SEQ ID NO: 63925 - DNA, 18 bp, synthetic construct
  source 1..18: mol_type = other DNA
aaatacaaatcattacag

SEQ ID NO: 63926 - DNA, 18 bp, synthetic construct
  source 1..18: mol_type = other DNA
aaatacaaatctctattg

SEQ ID NO: 63927 - DNA, 18 bp, synthetic construct
  source 1..18: mol_type = other DNA
aaatacaacaaacaatag

SEQ ID NO: 63928 - DNA, 18 bp, synthetic construct
  source 1..18: mol_type = other DNA
aaatacaacacacttcag

SEQ ID NO: 63929 - DNA, 18 bp, synthetic construct
  source 1..18: mol_type = other DNA
aaatacaagtcaataaag

SEQ ID NO: 63930 - DNA, 18 bp, synthetic construct
  source 1..18: mol_type = other DNA
aaatacacatgactatag

SEQ ID NO: 63931 - DNA, 18 bp, synthetic construct
  source 1..18: mol_type = other DNA
aaatacagctcacgctgg

SEQ ID NO: 63932 - DNA, 18 bp, synthetic construct
  source 1..18: mol_type = other DNA
aaatacatctcatttttg

SEQ ID NO: 63933 - DNA, 18 bp, synthetic construct
  source 1..18: mol_type = other DNA
aaataccactcatcattg

SEQ ID NO: 63934 - DNA, 18 bp, synthetic construct
  source 1..18: mol_type = other DNA
aaatacctctcgctttag

SEQ ID NO: 63935 - DNA, 18 bp, synthetic construct
  source 1..18: mol_type = other DNA
aaatacgaaactctttag

SEQ ID NO: 63936 - DNA, 18 bp, synthetic construct
  source 1..18: mol_type = other DNA
aaatacgaatccacacag

SEQ ID NO: 63937 - DNA, 18 bp, synthetic construct
  source 1..18: mol_type = other DNA
aaatacgaccagctatgg

SEQ ID NO: 63938 - DNA, 18 bp, synthetic construct
  source 1..18: mol_type = other DNA
aaatacgactatcaattg

SEQ ID NO: 63939 - DNA, 18 bp, synthetic construct
  source 1..18: mol_type = other DNA
aaatacgactcattgagg

SEQ ID NO: 63940 - DNA, 18 bp, synthetic construct
  source 1..18: mol_type = other DNA
aaatacgactcatttcgg

SEQ ID NO: 63941 - DNA, 18 bp, synthetic construct
  source 1..18: mol_type = other DNA
aaatacgactgtcttgag

SEQ ID NO: 63942 - DNA, 18 bp, synthetic construct
  source 1..18: mol_type = other DNA
aaatacgatctacaatag

SEQ ID NO: 63943 - DNA, 18 bp, synthetic construct
  source 1..18: mol_type = other DNA
aaatacgattcttttttg

SEQ ID NO: 63944 - DNA, 18 bp, synthetic construct
  source 1..18: mol_type = other DNA
aaatacgccccacattag

SEQ ID NO: 63945 - DNA, 18 bp, synthetic construct
  source 1..18: mol_type = other DNA
aaatacggcatacaaaag

SEQ ID NO: 63946 - DNA, 18 bp, synthetic construct
  source 1..18: mol_type = other DNA
aaatacgtatcaatacag

SEQ ID NO: 63947 - DNA, 18 bp, synthetic construct
  source 1..18: mol_type = other DNA
aaatacgtctaacattag

SEQ ID NO: 63948 - DNA, 18 bp, synthetic construct
  source 1..18: mol_type = other DNA
aaatacgtctagcttttg

SEQ ID NO: 63949 - DNA, 18 bp, synthetic construct
  source 1..18: mol_type = other DNA
aaatacgtctatttatgg

SEQ ID NO: 63950 - DNA, 18 bp, synthetic construct
  source 1..18: mol_type = other DNA
aaatactaatcacttcag

SEQ ID NO: 63951 - DNA, 18 bp, synthetic construct
  source 1..18: mol_type = other DNA
aaatactacactatattg

SEQ ID NO: 63952 - DNA, 18 bp, synthetic construct
  source 1..18: mol_type = other DNA
aaatactactcacattcg

SEQ ID NO: 63953 - DNA, 18 bp, synthetic construct
  source 1..18: mol_type = other DNA
aaatactacttattaccg

SEQ ID NO: 63954 - DNA, 18 bp, synthetic construct
  source 1..18: mol_type = other DNA
aaatactcttgtctatag

SEQ ID NO: 63955 - DNA, 18 bp, synthetic construct
  source 1..18: mol_type = other DNA
aaatactgatcactgttg

SEQ ID NO: 63956 - DNA, 18 bp, synthetic construct
  source 1..18: mol_type = other DNA
aaatactgcttgctatag

SEQ ID NO: 63957 - DNA, 18 bp, synthetic construct
  source 1..18: mol_type = other DNA
aaatacttctcagtaaag

SEQ ID NO: 63958 - DNA, 18 bp, synthetic construct
  source 1..18: mol_type = other DNA
aaatacttttcactaaag

SEQ ID NO: 63959 - DNA, 18 bp, synthetic construct
  source 1..18: mol_type = other DNA
aaatagctctcccagaag

SEQ ID NO: 63960 - DNA, 18 bp, synthetic construct
  source 1..18: mol_type = other DNA
aaataggactatgtatag

SEQ ID NO: 63961 - DNA, 18 bp, synthetic construct
  source 1..18: mol_type = other DNA
aaataggactcgcttttg

SEQ ID NO: 63962 - DNA, 18 bp, synthetic construct
  source 1..18: mol_type = other DNA
aaatataaaacaattttg

SEQ ID NO: 63963 - DNA, 18 bp, synthetic construct
  source 1..18: mol_type = other DNA
aaatatgactaaccaaag

SEQ ID NO: 63964 - DNA, 18 bp, synthetic construct
  source 1..18: mol_type = other DNA
aaatatgactaacttaag

SEQ ID NO: 63965 - DNA, 18 bp, synthetic construct
  source 1..18: mol_type = other DNA
aaatatgactctcttcag

SEQ ID NO: 63966 - DNA, 18 bp, synthetic construct
  source 1..18: mol_type = other DNA
aaatatgattcactaatg

SEQ ID NO: 63967 - DNA, 18 bp, synthetic construct
  source 1..18: mol_type = other DNA
aaatatgattcagaaaag

SEQ ID NO: 63968 - DNA, 18 bp, synthetic construct
  source 1..18: mol_type = other DNA
aaatatgcctcccattag

SEQ ID NO: 63969 - DNA, 18 bp, synthetic construct
  source 1..18: mol_type = other DNA
aaatcatactagcaatag

SEQ ID NO: 63970 - DNA, 18 bp, synthetic construct
  source 1..18: mol_type = other DNA
aaatccgaaccgctacgg

SEQ ID NO: 63971 - DNA, 18 bp, synthetic construct
  source 1..18: mol_type = other DNA
aaatcctactgactattg

SEQ ID NO: 63972 - DNA, 18 bp, synthetic construct
  source 1..18: mol_type = other DNA
aaatctgactaactatcg

SEQ ID NO: 63973 - DNA, 18 bp, synthetic construct
  source 1..18: mol_type = other DNA
aaatgatcatcactaatg

SEQ ID NO: 63974 - DNA, 18 bp, synthetic construct
  source 1..18: mol_type = other DNA
aaatgcctcactcttttg

SEQ ID NO: 63975 - DNA, 18 bp, synthetic construct
  source 1..18: mol_type = other DNA
aaatgcgtcacactattg

SEQ ID NO: 63976 - DNA, 18 bp, synthetic construct
  source 1..18: mol_type = other DNA
aaattagattctctatag

SEQ ID NO: 63977 - DNA, 18 bp, synthetic construct
  source 1..18: mol_type = other DNA
aaattcaacttagtatag

SEQ ID NO: 63978 - DNA, 18 bp, synthetic construct
  source 1..18: mol_type = other DNA
aaattccagtcatattag

SEQ ID NO: 63979 - DNA, 18 bp, synthetic construct
  source 1..18: mol_type = other DNA
aaattcgatacaatatag

SEQ ID NO: 63980 - DNA, 18 bp, synthetic construct
  source 1..18: mol_type = other DNA
aaattcgcctctctaaag

SEQ ID NO: 63981 - DNA, 18 bp, synthetic construct
  source 1..18: mol_type = other DNA
aaattcggctccgtatag

SEQ ID NO: 63982 - DNA, 18 bp, synthetic construct
  source 1..18: mol_type = other DNA
aaattctacacattctag

SEQ ID NO: 63983 - DNA, 18 bp, synthetic construct
  source 1..18: mol_type = other DNA
aaattctactcactaggg

SEQ ID NO: 63984 - DNA, 18 bp, synthetic construct
  source 1..18: mol_type = other DNA
aaattgctctgactattg

SEQ ID NO: 63985 - DNA, 18 bp, synthetic construct
  source 1..18: mol_type = other DNA
aaattggactcaatacag

SEQ ID NO: 63986 - DNA, 18 bp, synthetic construct
  source 1..18: mol_type = other DNA
aaatttgacacacaatag

SEQ ID NO: 63987 - DNA, 18 bp, synthetic construct
  source 1..18: mol_type = other DNA
aaatttgactcacaattg

SEQ ID NO: 63988 - DNA, 18 bp, synthetic construct
  source 1..18: mol_type = other DNA
aaatttgactcaccagag

SEQ ID NO: 63989 - DNA, 18 bp, synthetic construct
  source 1..18: mol_type = other DNA
aaatttttcttactagag

SEQ ID NO: 63990 - DNA, 18 bp, synthetic construct
  source 1..18: mol_type = other DNA
aacaaagagaaacaatag

SEQ ID NO: 63991 - DNA, 18 bp, synthetic construct
  source 1..18: mol_type = other DNA
aacatcggctcactaaag

SEQ ID NO: 63992 - DNA, 18 bp, synthetic construct
  source 1..18: mol_type = other DNA
aaccaagtctatctggcg

SEQ ID NO: 63993 - DNA, 18 bp, synthetic construct
  source 1..18: mol_type = other DNA
aactacaattcactaaag

SEQ ID NO: 63994 - DNA, 18 bp, synthetic construct
  source 1..18: mol_type = other DNA
aactacgtagccctatag

SEQ ID NO: 63995 - DNA, 18 bp, synthetic construct
  source 1..18: mol_type = other DNA
aactacgtctcacgaaag

SEQ ID NO: 63996 - DNA, 18 bp, synthetic construct
  source 1..18: mol_type = other DNA
aactactaatcagtatag

SEQ ID NO: 63997 - DNA, 18 bp, synthetic construct
  source 1..18: mol_type = other DNA
aacttcgtctcaccatcg

SEQ ID NO: 63998 - DNA, 18 bp, synthetic construct
  source 1..18: mol_type = other DNA
aagaaagactttcaatag

SEQ ID NO: 63999 - DNA, 18 bp, synthetic construct
  source 1..18: mol_type = other DNA
aagaacgcctcaaaatag

SEQ ID NO: 64000 - DNA, 18 bp, synthetic construct
  source 1..18: mol_type = other DNA
aagatcgattcactgttg

SEQ ID NO: 64001 - DNA, 18 bp, synthetic construct
  source 1..18: mol_type = other DNA
aaggccagctatctatag

SEQ ID NO: 64002 - DNA, 18 bp, synthetic construct
  source 1..18: mol_type = other DNA
aagtaagcctcatctttg

SEQ ID NO: 64003 - DNA, 18 bp, synthetic construct
  source 1..18: mol_type = other DNA
aagtacaattcagtttag

SEQ ID NO: 64004 - DNA, 18 bp, synthetic construct
  source 1..18: mol_type = other DNA
aagtacgactcaatgttg

SEQ ID NO: 64005 - DNA, 18 bp, synthetic construct
  source 1..18: mol_type = other DNA
aagtacgcctccctatgg

SEQ ID NO: 64006 - DNA, 18 bp, synthetic construct
  source 1..18: mol_type = other DNA
aagtacgtcattccatag

SEQ ID NO: 64007 - DNA, 18 bp, synthetic construct
  source 1..18: mol_type = other DNA
aagtacgtcctacttttg

SEQ ID NO: 64008 - DNA, 18 bp, synthetic construct
  source 1..18: mol_type = other DNA
aagtacgtctagctatag

SEQ ID NO: 64009 - DNA, 18 bp, synthetic construct
  source 1..18: mol_type = other DNA
aagtatgactcgctattg

SEQ ID NO: 64010 - DNA, 18 bp, synthetic construct
  source 1..18: mol_type = other DNA
aagtgcgtcacactcttg

SEQ ID NO: 64011 - DNA, 18 bp, synthetic construct
  source 1..18: mol_type = other DNA
aagtggtatccacaaagg

SEQ ID NO: 64012 - DNA, 18 bp, synthetic construct
  source 1..18: mol_type = other DNA
aagtgtgtctaactatgg

SEQ ID NO: 64013 - DNA, 18 bp, synthetic construct
  source 1..18: mol_type = other DNA
aagttcttcacaatacag

SEQ ID NO: 64014 - DNA, 18 bp, synthetic construct
  source 1..18: mol_type = other DNA
aataaattctcacaatag

SEQ ID NO: 64015 - DNA, 18 bp, synthetic construct
  source 1..18: mol_type = other DNA
aataaccactaactatag

SEQ ID NO: 64016 - DNA, 18 bp, synthetic construct
  source 1..18: mol_type = other DNA
aataacgactaaccattg

SEQ ID NO: 64017 - DNA, 18 bp, synthetic construct
  source 1..18: mol_type = other DNA
aataacgattctccccag

SEQ ID NO: 64018 - DNA, 18 bp, synthetic construct
  source 1..18: mol_type = other DNA
aataacgcctcactattg

SEQ ID NO: 64019 - DNA, 18 bp, synthetic construct
  source 1..18: mol_type = other DNA
aataacgtcttacgttag

SEQ ID NO: 64020 - DNA, 18 bp, synthetic construct
  source 1..18: mol_type = other DNA
aatatcgaatcccgttag

SEQ ID NO: 64021 - DNA, 18 bp, synthetic construct
  source 1..18: mol_type = other DNA
aatcactaatcagtttag

SEQ ID NO: 64022 - DNA, 18 bp, synthetic construct
  source 1..18: mol_type = other DNA
aatcactgctcacaaaag

SEQ ID NO: 64023 - DNA, 18 bp, synthetic construct
  source 1..18: mol_type = other DNA
aatcaggaataactatag

SEQ ID NO: 64024 - DNA, 18 bp, synthetic construct
  source 1..18: mol_type = other DNA
aatgacgacaaacaatag

SEQ ID NO: 64025 - DNA, 18 bp, synthetic construct
  source 1..18: mol_type = other DNA
aattaagattctatatag

SEQ ID NO: 64026 - DNA, 18 bp, synthetic construct
  source 1..18: mol_type = other DNA
aattaagcctctctaaag

SEQ ID NO: 64027 - DNA, 18 bp, synthetic construct
  source 1..18: mol_type = other DNA
aattaagtcccacttaag

SEQ ID NO: 64028 - DNA, 18 bp, synthetic construct
  source 1..18: mol_type = other DNA
aattacaagtcagcatag

SEQ ID NO: 64029 - DNA, 18 bp, synthetic construct
  source 1..18: mol_type = other DNA
aattacgaatcgctaaag

SEQ ID NO: 64030 - DNA, 18 bp, synthetic construct
  source 1..18: mol_type = other DNA
aattacgaatctgtatag

SEQ ID NO: 64031 - DNA, 18 bp, synthetic construct
  source 1..18: mol_type = other DNA
aattacgacacattaaag

SEQ ID NO: 64032 - DNA, 18 bp, synthetic construct
  source 1..18: mol_type = other DNA
aattacgacatactgtag

SEQ ID NO: 64033 - DNA, 18 bp, synthetic construct
  source 1..18: mol_type = other DNA
aattacgactcacagttg

SEQ ID NO: 64034 - DNA, 18 bp, synthetic construct
  source 1..18: mol_type = other DNA
aattacgactcataagag

SEQ ID NO: 64035 - DNA, 18 bp, synthetic construct
  source 1..18: mol_type = other DNA
aattacgactctccattg

SEQ ID NO: 64036 - DNA, 18 bp, synthetic construct
  source 1..18: mol_type = other DNA
aattacgcctctctttag

SEQ ID NO: 64037 - DNA, 18 bp, synthetic construct
  source 1..18: mol_type = other DNA
aattacgtcacaacatag

SEQ ID NO: 64038 - DNA, 18 bp, synthetic construct
  source 1..18: mol_type = other DNA
aattactactcaaagtag

SEQ ID NO: 64039 - DNA, 18 bp, synthetic construct
  source 1..18: mol_type = other DNA
aattactactcagtaaag

SEQ ID NO: 64040 - DNA, 18 bp, synthetic construct
  source 1..18: mol_type = other DNA
aattactacttactaaag

SEQ ID NO: 64041 - DNA, 18 bp, synthetic construct
  source 1..18: mol_type = other DNA
aattactcttcgctatag

SEQ ID NO: 64042 - DNA, 18 bp, synthetic construct
  source 1..18: mol_type = other DNA
aattataactcgctaaag

SEQ ID NO: 64043 - DNA, 18 bp, synthetic construct
  source 1..18: mol_type = other DNA
aattatacctcactatag

SEQ ID NO: 64044 - DNA, 18 bp, synthetic construct
  source 1..18: mol_type = other DNA
aattatcactcccgtaag

SEQ ID NO: 64045 - DNA, 18 bp, synthetic construct
  source 1..18: mol_type = other DNA
aattatgactcacaatgg

SEQ ID NO: 64046 - DNA, 18 bp, synthetic construct
  source 1..18: mol_type = other DNA
aattatgtctcgctatag

SEQ ID NO: 64047 - DNA, 18 bp, synthetic construct
  source 1..18: mol_type = other DNA
aattcccactcacatttg

SEQ ID NO: 64048 - DNA, 18 bp, synthetic construct
  source 1..18: mol_type = other DNA
aattccgactcactagcg

SEQ ID NO: 64049 - DNA, 18 bp, synthetic construct
  source 1..18: mol_type = other DNA
aattccgactctctctcg

SEQ ID NO: 64050 - DNA, 18 bp, synthetic construct
  source 1..18: mol_type = other DNA
aatttaggctctctattg

SEQ ID NO: 64051 - DNA, 18 bp, synthetic construct
  source 1..18: mol_type = other DNA
aatttatacaaactttag

SEQ ID NO: 64052 - DNA, 18 bp, synthetic construct
  source 1..18: mol_type = other DNA
aatttcaactcacattag

SEQ ID NO: 64053 - DNA, 18 bp, synthetic construct
  source 1..18: mol_type = other DNA
aatttcgaatctctgcag

SEQ ID NO: 64054 - DNA, 18 bp, synthetic construct
  source 1..18: mol_type = other DNA
aatttcgtcttccttaag

SEQ ID NO: 64055 - DNA, 18 bp, synthetic construct
  source 1..18: mol_type = other DNA
aattttgacatactaaag

SEQ ID NO: 64056 - DNA, 18 bp, synthetic construct
  source 1..18: mol_type = other DNA
acaaatgcaacactatag

SEQ ID NO: 64057 - DNA, 18 bp, synthetic construct
  source 1..18: mol_type = other DNA
acaatcgactcactctag

SEQ ID NO: 64058 - DNA, 18 bp, synthetic construct
  source 1..18: mol_type = other DNA
acaattgactcgcttttg

SEQ ID NO: 64059 - DNA, 18 bp, synthetic construct
  source 1..18: mol_type = other DNA
acacaagttacactgaag

SEQ ID NO: 64060 - DNA, 18 bp, synthetic construct
  source 1..18: mol_type = other DNA
acacacgactctacatag

SEQ ID NO: 64061 - DNA, 18 bp, synthetic construct
  source 1..18: mol_type = other DNA
acacacgtttcgttatcg

SEQ ID NO: 64062 - DNA, 18 bp, synthetic construct
  source 1..18: mol_type = other DNA
acagacgtctcaccattg

SEQ ID NO: 64063 - DNA, 18 bp, synthetic construct
  source 1..18: mol_type = other DNA
acatacaactcaccactg

SEQ ID NO: 64064 - DNA, 18 bp, synthetic construct
  source 1..18: mol_type = other DNA
acatacgagtcgctagag

SEQ ID NO: 64065 - DNA, 18 bp, synthetic construct
  source 1..18: mol_type = other DNA
acatacgatagccaagtg

SEQ ID NO: 64066 - DNA, 18 bp, synthetic construct
  source 1..18: mol_type = other DNA
acatacgtcaatctgtag

SEQ ID NO: 64067 - DNA, 18 bp, synthetic construct
  source 1..18: mol_type = other DNA
acatacgtcatcctatag

SEQ ID NO: 64068 - DNA, 18 bp, synthetic construct
  source 1..18: mol_type = other DNA
acatatgactcacaaaag

SEQ ID NO: 64069 - DNA, 18 bp, synthetic construct
  source 1..18: mol_type = other DNA
acatatggctcgctatag

SEQ ID NO: 64070 - DNA, 18 bp, synthetic construct
  source 1..18: mol_type = other DNA
acatccaaatcacaatag

SEQ ID NO: 64071 - DNA, 18 bp, synthetic construct
  source 1..18: mol_type = other DNA
acatgcgagtatttatag

SEQ ID NO: 64072 - DNA, 18 bp, synthetic construct
  source 1..18: mol_type = other DNA
acatgtgacactctatag

SEQ ID NO: 64073 - DNA, 18 bp, synthetic construct
  source 1..18: mol_type = other DNA
acattcgacactctctcg

SEQ ID NO: 64074 - DNA, 18 bp, synthetic construct
  source 1..18: mol_type = other DNA
acattcgactaactgtag

SEQ ID NO: 64075 - DNA, 18 bp, synthetic construct
  source 1..18: mol_type = other DNA
acattcgatacactatag

SEQ ID NO: 64076 - DNA, 18 bp, synthetic construct
  source 1..18: mol_type = other DNA
acctaccattccgtacag

SEQ ID NO: 64077 - DNA, 18 bp, synthetic construct
  source 1..18: mol_type = other DNA
acctacgactttctagag

SEQ ID NO: 64078 - DNA, 18 bp, synthetic construct
  source 1..18: mol_type = other DNA
acgaacgactctctatag

SEQ ID NO: 64079 - DNA, 18 bp, synthetic construct
  source 1..18: mol_type = other DNA
acgtacgactcactaatg

SEQ ID NO: 64080 - DNA, 18 bp, synthetic construct
  source 1..18: mol_type = other DNA
acgttctacttaatcttg

SEQ ID NO: 64081 - DNA, 18 bp, synthetic construct
  source 1..18: mol_type = other DNA
actcacgccacacaattg

SEQ ID NO: 64082 - DNA, 18 bp, synthetic construct
  source 1..18: mol_type = other DNA
acttacattccattgaag

SEQ ID NO: 64083 - DNA, 18 bp, synthetic construct
  source 1..18: mol_type = other DNA
actttcctctctctatag

SEQ ID NO: 64084 - DNA, 18 bp, synthetic construct
  source 1..18: mol_type = other DNA
actttcgactcactttag

SEQ ID NO: 64085 - DNA, 18 bp, synthetic construct
  source 1..18: mol_type = other DNA
agaaacgactcactgatg

SEQ ID NO: 64086 - DNA, 18 bp, synthetic construct
  source 1..18: mol_type = other DNA
agaaacgactctctattg

SEQ ID NO: 64087 - DNA, 18 bp, synthetic construct
  source 1..18: mol_type = other DNA
agaatcgtttttgtatag

SEQ ID NO: 64088 - DNA, 18 bp, synthetic construct
  source 1..18: mol_type = other DNA
agatactactcacttttg

SEQ ID NO: 64089 - DNA, 18 bp, synthetic construct
  source 1..18: mol_type = other DNA
agataggacacactatgg

SEQ ID NO: 64090 - DNA, 18 bp, synthetic construct
  source 1..18: mol_type = other DNA
agattcttttcaatttag

SEQ ID NO: 64091 - DNA, 18 bp, synthetic construct
  source 1..18: mol_type = other DNA
agctaagactcagtgtgg

SEQ ID NO: 64092 - DNA, 18 bp, synthetic construct
  source 1..18: mol_type = other DNA
agctgcgactcactaaag

SEQ ID NO: 64093 - DNA, 18 bp, synthetic construct
  source 1..18: mol_type = other DNA
aggtaagattcgctgtcg

SEQ ID NO: 64094 - DNA, 18 bp, synthetic construct
  source 1..18: mol_type = other DNA
ataaacggctcacaattg

SEQ ID NO: 64095 - DNA, 18 bp, synthetic construct
  source 1..18: mol_type = other DNA
ataaatcagtctctattg

SEQ ID NO: 64096 - DNA, 18 bp, synthetic construct
  source 1..18: mol_type = other DNA
ataaatgaccatctatag

SEQ ID NO: 64097 - DNA, 18 bp, synthetic construct
  source 1..18: mol_type = other DNA
ataaccgactcaatatag

SEQ ID NO: 64098 - DNA, 18 bp, synthetic construct
  source 1..18: mol_type = other DNA
ataagttactcacaaaag

SEQ ID NO: 64099 - DNA, 18 bp, synthetic construct
  source 1..18: mol_type = other DNA
atacaagattcacttttg

SEQ ID NO: 64100 - DNA, 18 bp, synthetic construct
  source 1..18: mol_type = other DNA
atacacaacgcactatag

SEQ ID NO: 64101 - DNA, 18 bp, synthetic construct
  source 1..18: mol_type = other DNA
atacaccactcactaacg

SEQ ID NO: 64102 - DNA, 18 bp, synthetic construct
  source 1..18: mol_type = other DNA
atacacgactatctatag

SEQ ID NO: 64103 - DNA, 18 bp, synthetic construct
  source 1..18: mol_type = other DNA
atacacgattctccatag

SEQ ID NO: 64104 - DNA, 18 bp, synthetic construct
  source 1..18: mol_type = other DNA
atacacgcctaactgtag

SEQ ID NO: 64105 - DNA, 18 bp, synthetic construct
  source 1..18: mol_type = other DNA
atacacttcttacagtag

SEQ ID NO: 64106 - DNA, 18 bp, synthetic construct
  source 1..18: mol_type = other DNA
atactcgttcgacattcg

SEQ ID NO: 64107 - DNA, 18 bp, synthetic construct
  source 1..18: mol_type = other DNA
atagacgacacaaaatag

SEQ ID NO: 64108 - DNA, 18 bp, synthetic construct
  source 1..18: mol_type = other DNA
atagacgactcaatttag

SEQ ID NO: 64109 - DNA, 18 bp, synthetic construct
  source 1..18: mol_type = other DNA
atataaaactcattatag

SEQ ID NO: 64110 - DNA, 18 bp, synthetic construct
  source 1..18: mol_type = other DNA
atataagactaattatag

SEQ ID NO: 64111 - DNA, 18 bp, synthetic construct
  source 1..18: mol_type = other DNA
atataagtcactctatag

SEQ ID NO: 64112 - DNA, 18 bp, synthetic construct
  source 1..18: mol_type = other DNA
atatacaaatcacattag

SEQ ID NO: 64113 - DNA, 18 bp, synthetic construct
  source 1..18: mol_type = other DNA
atatacaacacactattg

SEQ ID NO: 64114 - DNA, 18 bp, synthetic construct
  source 1..18: mol_type = other DNA
atatacaactctcactag

SEQ ID NO: 64115 - DNA, 18 bp, synthetic construct
  source 1..18: mol_type = other DNA
atataccaatccttagag

SEQ ID NO: 64116 - DNA, 18 bp, synthetic construct
  source 1..18: mol_type = other DNA
atatacgacataccattg

SEQ ID NO: 64117 - DNA, 18 bp, synthetic construct
  source 1..18: mol_type = other DNA
atatacgactatacaaag

SEQ ID NO: 64118 - DNA, 18 bp, synthetic construct
  source 1..18: mol_type = other DNA
atatacgattcaatattg

SEQ ID NO: 64119 - DNA, 18 bp, synthetic construct
  source 1..18: mol_type = other DNA
atatacgattccgtttag

SEQ ID NO: 64120 - DNA, 18 bp, synthetic construct
  source 1..18: mol_type = other DNA
atatacgccattctatag

SEQ ID NO: 64121 - DNA, 18 bp, synthetic construct
  source 1..18: mol_type = other DNA
atatacgcctgactaatg

SEQ ID NO: 64122 - DNA, 18 bp, synthetic construct
  source 1..18: mol_type = other DNA
atatacgtttcaccatcg

SEQ ID NO: 64123 - DNA, 18 bp, synthetic construct
  source 1..18: mol_type = other DNA
atatactactcaatctag

SEQ ID NO: 64124 - DNA, 18 bp, synthetic construct
  source 1..18: mol_type = other DNA
atatactactcacaagag

SEQ ID NO: 64125 - DNA, 18 bp, synthetic construct
  source 1..18: mol_type = other DNA
atatactcttcaatatag

SEQ ID NO: 64126 - DNA, 18 bp, synthetic construct
  source 1..18: mol_type = other DNA
atatacttcactctatag

SEQ ID NO: 64127 - DNA, 18 bp, synthetic construct
  source 1..18: mol_type = other DNA
atataggactttctttag

SEQ ID NO: 64128 - DNA, 18 bp, synthetic construct
  source 1..18: mol_type = other DNA
atatagtacttactaaag

SEQ ID NO: 64129 - DNA, 18 bp, synthetic construct
  source 1..18: mol_type = other DNA
atatatgaatcactatcg

SEQ ID NO: 64130 - DNA, 18 bp, synthetic construct
  source 1..18: mol_type = other DNA
atatcccacccactatag

SEQ ID NO: 64131 - DNA, 18 bp, synthetic construct
  source 1..18: mol_type = other DNA
atatccgcctcaccatag

SEQ ID NO: 64132 - DNA, 18 bp, synthetic construct
  source 1..18: mol_type = other DNA
atatgagacacactttag

SEQ ID NO: 64133 - DNA, 18 bp, synthetic construct
  source 1..18: mol_type = other DNA
atatgagactcactgctg

SEQ ID NO: 64134 - DNA, 18 bp, synthetic construct
  source 1..18: mol_type = other DNA
atatgcggtacattatag

SEQ ID NO: 64135 - DNA, 18 bp, synthetic construct
  source 1..18: mol_type = other DNA
atatgctagtcacttgag

SEQ ID NO: 64136 - DNA, 18 bp, synthetic construct
  source 1..18: mol_type = other DNA
atatgcttctcgatatag

SEQ ID NO: 64137 - DNA, 18 bp, synthetic construct
  source 1..18: mol_type = other DNA
atattagtctgactatag

SEQ ID NO: 64138 - DNA, 18 bp, synthetic construct
  source 1..18: mol_type = other DNA
atattcatctaaccatag

SEQ ID NO: 64139 - DNA, 18 bp, synthetic construct
  source 1..18: mol_type = other DNA
atattccactaactatag

SEQ ID NO: 64140 - DNA, 18 bp, synthetic construct
  source 1..18: mol_type = other DNA
atattcgactcacacaag

SEQ ID NO: 64141 - DNA, 18 bp, synthetic construct
  source 1..18: mol_type = other DNA
atattcgacttccttatg

SEQ ID NO: 64142 - DNA, 18 bp, synthetic construct
  source 1..18: mol_type = other DNA
atattctacttacaatag

SEQ ID NO: 64143 - DNA, 18 bp, synthetic construct
  source 1..18: mol_type = other DNA
atattgaatactctatag

SEQ ID NO: 64144 - DNA, 18 bp, synthetic construct
  source 1..18: mol_type = other DNA
atattggactgtatgtag

SEQ ID NO: 64145 - DNA, 18 bp, synthetic construct
  source 1..18: mol_type = other DNA
atattggtctatctattg

SEQ ID NO: 64146 - DNA, 18 bp, synthetic construct
  source 1..18: mol_type = other DNA
atcaacatctcacaatag

SEQ ID NO: 64147 - DNA, 18 bp, synthetic construct
  source 1..18: mol_type = other DNA
atccaatacacacattag

SEQ ID NO: 64148 - DNA, 18 bp, synthetic construct
  source 1..18: mol_type = other DNA
atctacgacttacataag

SEQ ID NO: 64149 - DNA, 18 bp, synthetic construct
  source 1..18: mol_type = other DNA
atctacgtctcactaaag

SEQ ID NO: 64150 - DNA, 18 bp, synthetic construct
  source 1..18: mol_type = other DNA
atctacgtcttactaaag

SEQ ID NO: 64151 - DNA, 18 bp, synthetic construct
  source 1..18: mol_type = other DNA
atcttgggcacactaatg

SEQ ID NO: 64152 - DNA, 18 bp, synthetic construct
  source 1..18: mol_type = other DNA
atcttgggctctctacag

SEQ ID NO: 64153 - DNA, 18 bp, synthetic construct
  source 1..18: mol_type = other DNA
atgtacgagtcactattg

SEQ ID NO: 64154 - DNA, 18 bp, synthetic construct
  source 1..18: mol_type = other DNA
atgtactaagcactatag

SEQ ID NO: 64155 - DNA, 18 bp, synthetic construct
  source 1..18: mol_type = other DNA
atgtcctactcactattg

SEQ ID NO: 64156 - DNA, 18 bp, synthetic construct
  source 1..18: mol_type = other DNA
atgttctaccctctaaag

SEQ ID NO: 64157 - DNA, 18 bp, synthetic construct
  source 1..18: mol_type = other DNA
attaaagattcactatag

SEQ ID NO: 64158 - DNA, 18 bp, synthetic construct
  source 1..18: mol_type = other DNA
attcacgagcctccatag

SEQ ID NO: 64159 - DNA, 18 bp, synthetic construct
  source 1..18: mol_type = other DNA
attcattactcatcatag

SEQ ID NO: 64160 - DNA, 18 bp, synthetic construct
  source 1..18: mol_type = other DNA
atttaagtcttactatag

SEQ ID NO: 64161 - DNA, 18 bp, synthetic construct
  source 1..18: mol_type = other DNA
atttacatttaactatag

SEQ ID NO: 64162 - DNA, 18 bp, synthetic construct
  source 1..18: mol_type = other DNA
atttaccactctccatcg

SEQ ID NO: 64163 - DNA, 18 bp, synthetic construct
  source 1..18: mol_type = other DNA
atttacgactaactaaag

SEQ ID NO: 64164 - DNA, 18 bp, synthetic construct
  source 1..18: mol_type = other DNA
atttacgtctttcaatag

SEQ ID NO: 64165 - DNA, 18 bp, synthetic construct
  source 1..18: mol_type = other DNA
atttatgactaattacag

SEQ ID NO: 64166 - DNA, 18 bp, synthetic construct
  source 1..18: mol_type = other DNA
atttatgattcactaatg

SEQ ID NO: 64167 - DNA, 18 bp, synthetic construct
  source 1..18: mol_type = other DNA
caaaaccactctgaatag

SEQ ID NO: 64168 - DNA, 18 bp, synthetic construct
  source 1..18: mol_type = other DNA
caaaacgacacgctgttg

SEQ ID NO: 64169 - DNA, 18 bp, synthetic construct
  source 1..18: mol_type = other DNA
caaaacgacactatatag

SEQ ID NO: 64170 - DNA, 18 bp, synthetic construct
  source 1..18: mol_type = other DNA
caaaacgactgattattg

SEQ ID NO: 64171 - DNA, 18 bp, synthetic construct
  source 1..18: mol_type = other DNA
caaaactactcaaaatag

SEQ ID NO: 64172 - DNA, 18 bp, synthetic construct
  source 1..18: mol_type = other DNA
caaaatatcttcctatag

SEQ ID NO: 64173 - DNA, 18 bp, synthetic construct
  source 1..18: mol_type = other DNA
caaaccgactcaatctag

SEQ ID NO: 64174 - DNA, 18 bp, synthetic construct
  source 1..18: mol_type = other DNA
caaatcaactcaatgtag

SEQ ID NO: 64175 - DNA, 18 bp, synthetic construct
  source 1..18: mol_type = other DNA
caaattgttagactgctg

SEQ ID NO: 64176 - DNA, 18 bp, synthetic construct
  source 1..18: mol_type = other DNA
caacaagtcaaactctag

SEQ ID NO: 64177 - DNA, 18 bp, synthetic construct
  source 1..18: mol_type = other DNA
caacacaaaacactaaag

SEQ ID NO: 64178 - DNA, 18 bp, synthetic construct
  source 1..18: mol_type = other DNA
caacacatctcactctag

SEQ ID NO: 64179 - DNA, 18 bp, synthetic construct
  source 1..18: mol_type = other DNA
caacacgcataacaatgg

SEQ ID NO: 64180 - DNA, 18 bp, synthetic construct
  source 1..18: mol_type = other DNA
caacgcgagccagtatag

SEQ ID NO: 64181 - DNA, 18 bp, synthetic construct
  source 1..18: mol_type = other DNA
caactggatgcactatag

SEQ ID NO: 64182 - DNA, 18 bp, synthetic construct
  source 1..18: mol_type = other DNA
caagacggctccctttag

SEQ ID NO: 64183 - DNA, 18 bp, synthetic construct
  source 1..18: mol_type = other DNA
caagacgtatcattattg

SEQ ID NO: 64184 - DNA, 18 bp, synthetic construct
  source 1..18: mol_type = other DNA
caataagtctcacttatg

SEQ ID NO: 64185 - DNA, 18 bp, synthetic construct
  source 1..18: mol_type = other DNA
caataagtctcgctgaag

SEQ ID NO: 64186 - DNA, 18 bp, synthetic construct
  source 1..18: mol_type = other DNA
caatacaactctttatcg

SEQ ID NO: 64187 - DNA, 18 bp, synthetic construct
  source 1..18: mol_type = other DNA
caatacaacttcataaag

SEQ ID NO: 64188 - DNA, 18 bp, synthetic construct
  source 1..18: mol_type = other DNA
caatacatctaactacag

SEQ ID NO: 64189 - DNA, 18 bp, synthetic construct
  source 1..18: mol_type = other DNA
caataccactccttagtg

SEQ ID NO: 64190 - DNA, 18 bp, synthetic construct
  source 1..18: mol_type = other DNA
caataccactttctggag

SEQ ID NO: 64191 - DNA, 18 bp, synthetic construct
  source 1..18: mol_type = other DNA
caatacgaaccactttgg

SEQ ID NO: 64192 - DNA, 18 bp, synthetic construct
  source 1..18: mol_type = other DNA
caatacgaatcgcacttg

SEQ ID NO: 64193 - DNA, 18 bp, synthetic construct
  source 1..18: mol_type = other DNA
caatacgactcttaactg

SEQ ID NO: 64194 - DNA, 18 bp, synthetic construct
  source 1..18: mol_type = other DNA
caatacgattctcttaag

SEQ ID NO: 64195 - DNA, 18 bp, synthetic construct
  source 1..18: mol_type = other DNA
caatacgccactcaaatg

SEQ ID NO: 64196 - DNA, 18 bp, synthetic construct
  source 1..18: mol_type = other DNA
caatacggcttacggtag

SEQ ID NO: 64197 - DNA, 18 bp, synthetic construct
  source 1..18: mol_type = other DNA
caatacgtcaaactttag

SEQ ID NO: 64198 - DNA, 18 bp, synthetic construct
  source 1..18: mol_type = other DNA
caatacgtcaccattttg

SEQ ID NO: 64199 - DNA, 18 bp, synthetic construct
  source 1..18: mol_type = other DNA
caatactaatcacacgtg

SEQ ID NO: 64200 - DNA, 18 bp, synthetic construct
  source 1..18: mol_type = other DNA
caatactactcactgatg

SEQ ID NO: 64201 - DNA, 18 bp, synthetic construct
  source 1..18: mol_type = other DNA
caatatgacccacaattg

SEQ ID NO: 64202 - DNA, 18 bp, synthetic construct
  source 1..18: mol_type = other DNA
caatatgacttactgaag

SEQ ID NO: 64203 - DNA, 18 bp, synthetic construct
  source 1..18: mol_type = other DNA
caatatgagtcctgatag

SEQ ID NO: 64204 - DNA, 18 bp, synthetic construct
  source 1..18: mol_type = other DNA
caatccgattcactcttg

SEQ ID NO: 64205 - DNA, 18 bp, synthetic construct
  source 1..18: mol_type = other DNA
caatctgtttcacaatag

SEQ ID NO: 64206 - DNA, 18 bp, synthetic construct
  source 1..18: mol_type = other DNA
caatgcgtctcacaacag

SEQ ID NO: 64207 - DNA, 18 bp, synthetic construct
  source 1..18: mol_type = other DNA
caatgcgtctctctaaag

SEQ ID NO: 64208 - DNA, 18 bp, synthetic construct
  source 1..18: mol_type = other DNA
caattcatctcagtttgg

SEQ ID NO: 64209 - DNA, 18 bp, synthetic construct
  source 1..18: mol_type = other DNA
caattcgaataaccctag

SEQ ID NO: 64210 - DNA, 18 bp, synthetic construct
  source 1..18: mol_type = other DNA
caattcgacacactcatg

SEQ ID NO: 64211 - DNA, 18 bp, synthetic construct
  source 1..18: mol_type = other DNA
caattcgacttacaatcg

SEQ ID NO: 64212 - DNA, 18 bp, synthetic construct
  source 1..18: mol_type = other DNA
caattcgtatcacaatag

SEQ ID NO: 64213 - DNA, 18 bp, synthetic construct
  source 1..18: mol_type = other DNA
caatttctctcactactg

SEQ ID NO: 64214 - DNA, 18 bp, synthetic construct
  source 1..18: mol_type = other DNA
cacatcgactcactattg

SEQ ID NO: 64215 - DNA, 18 bp, synthetic construct
  source 1..18: mol_type = other DNA
caccaacactcacgcttg

SEQ ID NO: 64216 - DNA, 18 bp, synthetic construct
  source 1..18: mol_type = other DNA
caccaatactcactaaag

SEQ ID NO: 64217 - DNA, 18 bp, synthetic construct
  source 1..18: mol_type = other DNA
caccgtcacacactatag

SEQ ID NO: 64218 - DNA, 18 bp, synthetic construct
  source 1..18: mol_type = other DNA
cactacgtccatcgtaag

SEQ ID NO: 64219 - DNA, 18 bp, synthetic construct
  source 1..18: mol_type = other DNA
cactgcgattccctagtg

SEQ ID NO: 64220 - DNA, 18 bp, synthetic construct
  source 1..18: mol_type = other DNA
cacttcaaatcgatttag

SEQ ID NO: 64221 - DNA, 18 bp, synthetic construct
  source 1..18: mol_type = other DNA
cagtacgaatcactccag

SEQ ID NO: 64222 - DNA, 18 bp, synthetic construct
  source 1..18: mol_type = other DNA
cagtactactcatcatcg

SEQ ID NO: 64223 - DNA, 18 bp, synthetic construct
  source 1..18: mol_type = other DNA
cagtactagacagtattg

SEQ ID NO: 64224 - DNA, 18 bp, synthetic construct
  source 1..18: mol_type = other DNA
cagtccgactcaggaatg

SEQ ID NO: 64225 - DNA, 18 bp, synthetic construct
  source 1..18: mol_type = other DNA
cagtctgactcacaatag

SEQ ID NO: 64226 - DNA, 18 bp, synthetic construct
  source 1..18: mol_type = other DNA
cagtgcgactcgctaaag

SEQ ID NO: 64227 - DNA, 18 bp, synthetic construct
  source 1..18: mol_type = other DNA
cagttcgtatcactacag

SEQ ID NO: 64228 - DNA, 18 bp, synthetic construct
  source 1..18: mol_type = other DNA
cataacgtctcagtttag

SEQ ID NO: 64229 - DNA, 18 bp, synthetic construct
  source 1..18: mol_type = other DNA
catatccattcactatag

SEQ ID NO: 64230 - DNA, 18 bp, synthetic construct
  source 1..18: mol_type = other DNA
catcacggttcaacattg

SEQ ID NO: 64231 - DNA, 18 bp, synthetic construct
  source 1..18: mol_type = other DNA
catcactacatgcgttgg

SEQ ID NO: 64232 - DNA, 18 bp, synthetic construct
  source 1..18: mol_type = other DNA
cattaagaatcactattg

SEQ ID NO: 64233 - DNA, 18 bp, synthetic construct
  source 1..18: mol_type = other DNA
cattaagaattaccaaag

SEQ ID NO: 64234 - DNA, 18 bp, synthetic construct
  source 1..18: mol_type = other DNA
cattacaactcaccaaag

SEQ ID NO: 64235 - DNA, 18 bp, synthetic construct
  source 1..18: mol_type = other DNA
cattacaactcgctatcg

SEQ ID NO: 64236 - DNA, 18 bp, synthetic construct
  source 1..18: mol_type = other DNA
cattacgaatcgatatag

SEQ ID NO: 64237 - DNA, 18 bp, synthetic construct
  source 1..18: mol_type = other DNA
cattacgattccctttag

SEQ ID NO: 64238 - DNA, 18 bp, synthetic construct
  source 1..18: mol_type = other DNA
cattacgattctctacag

SEQ ID NO: 64239 - DNA, 18 bp, synthetic construct
  source 1..18: mol_type = other DNA
cattacgttaaactattg

SEQ ID NO: 64240 - DNA, 18 bp, synthetic construct
  source 1..18: mol_type = other DNA
cattataaatgccatcag

SEQ ID NO: 64241 - DNA, 18 bp, synthetic construct
  source 1..18: mol_type = other DNA
cattcagtctcactattg

SEQ ID NO: 64242 - DNA, 18 bp, synthetic construct
  source 1..18: mol_type = other DNA
cattccgtcaccctaaag

SEQ ID NO: 64243 - DNA, 18 bp, synthetic construct
  source 1..18: mol_type = other DNA
cattgggcctcactacag

SEQ ID NO: 64244 - DNA, 18 bp, synthetic construct
  source 1..18: mol_type = other DNA
catttctacacactgttg

SEQ ID NO: 64245 - DNA, 18 bp, synthetic construct
  source 1..18: mol_type = other DNA
ccaccccactcactatag

SEQ ID NO: 64246 - DNA, 18 bp, synthetic construct
  source 1..18: mol_type = other DNA
ccatacgaaacacaatag

SEQ ID NO: 64247 - DNA, 18 bp, synthetic construct
  source 1..18: mol_type = other DNA
ccatactactcacaaggg

SEQ ID NO: 64248 - DNA, 18 bp, synthetic construct
  source 1..18: mol_type = other DNA
ccatatgcctcagttttg

SEQ ID NO: 64249 - DNA, 18 bp, synthetic construct
  source 1..18: mol_type = other DNA
ccatgcgagacactttag

SEQ ID NO: 64250 - DNA, 18 bp, synthetic construct
  source 1..18: mol_type = other DNA
ccattctactcaatatag

SEQ ID NO: 64251 - DNA, 18 bp, synthetic construct
  source 1..18: mol_type = other DNA
ccatttggctcagtatgg

SEQ ID NO: 64252 - DNA, 18 bp, synthetic construct
  source 1..18: mol_type = other DNA
ccgtaagacccactatag

SEQ ID NO: 64253 - DNA, 18 bp, synthetic construct
  source 1..18: mol_type = other DNA
ccgtacgtccacttatag

SEQ ID NO: 64254 - DNA, 18 bp, synthetic construct
  source 1..18: mol_type = other DNA
ccttactactcaccttag

SEQ ID NO: 64255 - DNA, 18 bp, synthetic construct
  source 1..18: mol_type = other DNA
cgatacccttctttatag

SEQ ID NO: 64256 - DNA, 18 bp, synthetic construct
  source 1..18: mol_type = other DNA
cgtaactaatcactatag

SEQ ID NO: 64257 - DNA, 18 bp, synthetic construct
  source 1..18: mol_type = other DNA
cgtaacttctcgctctag

SEQ ID NO: 64258 - DNA, 18 bp, synthetic construct
  source 1..18: mol_type = other DNA
ctaaacgaatcacttttg

SEQ ID NO: 64259 - DNA, 18 bp, synthetic construct
  source 1..18: mol_type = other DNA
ctaaacgactcattaaag

SEQ ID NO: 64260 - DNA, 18 bp, synthetic construct
  source 1..18: mol_type = other DNA
ctaaacgactttctacag

SEQ ID NO: 64261 - DNA, 18 bp, synthetic construct
  source 1..18: mol_type = other DNA
ctaagtgaatctctatag

SEQ ID NO: 64262 - DNA, 18 bp, synthetic construct
  source 1..18: mol_type = other DNA
ctaatcgaatcactatag

SEQ ID NO: 64263 - DNA, 18 bp, synthetic construct
  source 1..18: mol_type = other DNA
ctacaagtcacagaatcg

SEQ ID NO: 64264 - DNA, 18 bp, synthetic construct
  source 1..18: mol_type = other DNA
ctacacggttcacaattg

SEQ ID NO: 64265 - DNA, 18 bp, synthetic construct
  source 1..18: mol_type = other DNA
ctagtcaagcctctatag

SEQ ID NO: 64266 - DNA, 18 bp, synthetic construct
  source 1..18: mol_type = other DNA
ctataaaaattattatag

SEQ ID NO: 64267 - DNA, 18 bp, synthetic construct
  source 1..18: mol_type = other DNA
ctatacgacagcccaaag

SEQ ID NO: 64268 - DNA, 18 bp, synthetic construct
  source 1..18: mol_type = other DNA
ctatacgacccactaacg

SEQ ID NO: 64269 - DNA, 18 bp, synthetic construct
  source 1..18: mol_type = other DNA
ctatacgactcaacacag

SEQ ID NO: 64270 - DNA, 18 bp, synthetic construct
  source 1..18: mol_type = other DNA
ctatacgactcacataag

SEQ ID NO: 64271 - DNA, 18 bp, synthetic construct
  source 1..18: mol_type = other DNA
ctatacgcctctcattag

SEQ ID NO: 64272 - DNA, 18 bp, synthetic construct
  source 1..18: mol_type = other DNA
ctatacgtctaactatgg

SEQ ID NO: 64273 - DNA, 18 bp, synthetic construct
  source 1..18: mol_type = other DNA
ctatacgtctccccatcg

SEQ ID NO: 64274 - DNA, 18 bp, synthetic construct
  source 1..18: mol_type = other DNA
ctatacttgccactgttg

SEQ ID NO: 64275 - DNA, 18 bp, synthetic construct
  source 1..18: mol_type = other DNA
ctatatcattcagtattg

SEQ ID NO: 64276 - DNA, 18 bp, synthetic construct
  source 1..18: mol_type = other DNA
ctatatcttccgtgatag

SEQ ID NO: 64277 - DNA, 18 bp, synthetic construct
  source 1..18: mol_type = other DNA
ctatatgactctctttag

SEQ ID NO: 64278 - DNA, 18 bp, synthetic construct
  source 1..18: mol_type = other DNA
ctatatgactgagtctag

SEQ ID NO: 64279 - DNA, 18 bp, synthetic construct
  source 1..18: mol_type = other DNA
ctatccgacatattgtag

SEQ ID NO: 64280 - DNA, 18 bp, synthetic construct
  source 1..18: mol_type = other DNA
ctatgtcacacactatag

SEQ ID NO: 64281 - DNA, 18 bp, synthetic construct
  source 1..18: mol_type = other DNA
ctatttgacacactatag

SEQ ID NO: 64282 - DNA, 18 bp, synthetic construct
  source 1..18: mol_type = other DNA
ctctacggcactttacag

SEQ ID NO: 64283 - DNA, 18 bp, synthetic construct
  source 1..18: mol_type = other DNA
ctgtacgactcattaccg

SEQ ID NO: 64284 - DNA, 18 bp, synthetic construct
  source 1..18: mol_type = other DNA
cttaatgagtctcaatag

SEQ ID NO: 64285 - DNA, 18 bp, synthetic construct
  source 1..18: mol_type = other DNA
cttatcgcctctctatag

SEQ ID NO: 64286 - DNA, 18 bp, synthetic construct
  source 1..18: mol_type = other DNA
cttcacgacgcactatag

SEQ ID NO: 64287 - DNA, 18 bp, synthetic construct
  source 1..18: mol_type = other DNA
ctttacaactctctttag

SEQ ID NO: 64288 - DNA, 18 bp, synthetic construct
  source 1..18: mol_type = other DNA
gaaaacgtctccatacag

SEQ ID NO: 64289 - DNA, 18 bp, synthetic construct
  source 1..18: mol_type = other DNA
gaaaatgacttactttag

SEQ ID NO: 64290 - DNA, 18 bp, synthetic construct
  source 1..18: mol_type = other DNA
gaaagcgtcacactatag

SEQ ID NO: 64291 - DNA, 18 bp, synthetic construct
  source 1..18: mol_type = other DNA
gaacccgtctcatggttg

SEQ ID NO: 64292 - DNA, 18 bp, synthetic construct
  source 1..18: mol_type = other DNA
gaacttgattcacagtag

SEQ ID NO: 64293 - DNA, 18 bp, synthetic construct
  source 1..18: mol_type = other DNA
gaatacaattcaatattg

SEQ ID NO: 64294 - DNA, 18 bp, synthetic construct
  source 1..18: mol_type = other DNA
gaatacatctctctgctg

SEQ ID NO: 64295 - DNA, 18 bp, synthetic construct
  source 1..18: mol_type = other DNA
gaatacgagacgcttcag

SEQ ID NO: 64296 - DNA, 18 bp, synthetic construct
  source 1..18: mol_type = other DNA
gaatccgactcgttattg

SEQ ID NO: 64297 - DNA, 18 bp, synthetic construct
  source 1..18: mol_type = other DNA
gaatgcgcttaaccattg

SEQ ID NO: 64298 - DNA, 18 bp, synthetic construct
  source 1..18: mol_type = other DNA
gaatgcgtctcgctgtag

SEQ ID NO: 64299 - DNA, 18 bp, synthetic construct
  source 1..18: mol_type = other DNA
gaatgggagtatctgttg

SEQ ID NO: 64300 - DNA, 18 bp, synthetic construct
  source 1..18: mol_type = other DNA
gaattcctctcaccattg

SEQ ID NO: 64301 - DNA, 18 bp, synthetic construct
  source 1..18: mol_type = other DNA
gaattctactccctcttg

SEQ ID NO: 64302 - DNA, 18 bp, synthetic construct
  source 1..18: mol_type = other DNA
gaatttgagtcaatattg

SEQ ID NO: 64303 - DNA, 18 bp, synthetic construct
  source 1..18: mol_type = other DNA
gagtacgagtcgcaatag

SEQ ID NO: 64304 - DNA, 18 bp, synthetic construct
  source 1..18: mol_type = other DNA
gagtgcgttgcactaaag

SEQ ID NO: 64305 - DNA, 18 bp, synthetic construct
  source 1..18: mol_type = other DNA
gattacgacctaatatag

SEQ ID NO: 64306 - DNA, 18 bp, synthetic construct
  source 1..18: mol_type = other DNA
gattactactctctttag

SEQ ID NO: 64307 - DNA, 18 bp, synthetic construct
  source 1..18: mol_type = other DNA
gattatgattcagtttag

SEQ ID NO: 64308 - DNA, 18 bp, synthetic construct
  source 1..18: mol_type = other DNA
gcatacaattcactttag

SEQ ID NO: 64309 - DNA, 18 bp, synthetic construct
  source 1..18: mol_type = other DNA
gcatacgtatctcttttg

SEQ ID NO: 64310 - DNA, 18 bp, synthetic construct
  source 1..18: mol_type = other DNA
gcataggatttactattg

SEQ ID NO: 64311 - DNA, 18 bp, synthetic construct
  source 1..18: mol_type = other DNA
gcatatgactcaccaaag

SEQ ID NO: 64312 - DNA, 18 bp, synthetic construct
  source 1..18: mol_type = other DNA
gcccacgattctcgatag

SEQ ID NO: 64313 - DNA, 18 bp, synthetic construct
  source 1..18: mol_type = other DNA
gcgttacactcactattg

SEQ ID NO: 64314 - DNA, 18 bp, synthetic construct
  source 1..18: mol_type = other DNA
gcttacgactatctatag

SEQ ID NO: 64315 - DNA, 18 bp, synthetic construct
  source 1..18: mol_type = other DNA
gcttactactcactgtag

SEQ ID NO: 64316 - DNA, 18 bp, synthetic construct
  source 1..18: mol_type = other DNA
ggaatcgactcactatcg

SEQ ID NO: 64317 - DNA, 18 bp, synthetic construct
  source 1..18: mol_type = other DNA
ggagacgtttaactatag

SEQ ID NO: 64318 - DNA, 18 bp, synthetic construct
  source 1..18: mol_type = other DNA
ggattagacacactttag

SEQ ID NO: 64319 - DNA, 18 bp, synthetic construct
  source 1..18: mol_type = other DNA
gtataagactcaatagtg

SEQ ID NO: 64320 - DNA, 18 bp, synthetic construct
  source 1..18: mol_type = other DNA
gtataatgctcactatag

SEQ ID NO: 64321 - DNA, 18 bp, synthetic construct
  source 1..18: mol_type = other DNA
gtatacgacccactccag

SEQ ID NO: 64322 - DNA, 18 bp, synthetic construct
  source 1..18: mol_type = other DNA
gtatacgactaacaaatg

SEQ ID NO: 64323 - DNA, 18 bp, synthetic construct
  source 1..18: mol_type = other DNA
gtatcatactctctattg

SEQ ID NO: 64324 - DNA, 18 bp, synthetic construct
  source 1..18: mol_type = other DNA
gtatgcgactcacaatcg

SEQ ID NO: 64325 - DNA, 18 bp, synthetic construct
  source 1..18: mol_type = other DNA
gtattaggctcactagcg

SEQ ID NO: 64326 - DNA, 18 bp, synthetic construct
  source 1..18: mol_type = other DNA
gttacagactcacttatg

SEQ ID NO: 64327 - DNA, 18 bp, synthetic construct
  source 1..18: mol_type = other DNA
gttcacctctcactaagg

SEQ ID NO: 64328 - DNA, 18 bp, synthetic construct
  source 1..18: mol_type = other DNA
gtttacgactcaatattg

SEQ ID NO: 64329 - DNA, 18 bp, synthetic construct
  source 1..18: mol_type = other DNA
taaaaaaatacactatag

SEQ ID NO: 64330 - DNA, 18 bp, synthetic construct
  source 1..18: mol_type = other DNA
taaaaagacacacttttg

SEQ ID NO: 64331 - DNA, 18 bp, synthetic construct
  source 1..18: mol_type = other DNA
taaaaagactaaggatag

SEQ ID NO: 64332 - DNA, 18 bp, synthetic construct
  source 1..18: mol_type = other DNA
taaaaagactcacaaatg

SEQ ID NO: 64333 - DNA, 18 bp, synthetic construct
  source 1..18: mol_type = other DNA
taaaaagactgaccattg

SEQ ID NO: 64334 - DNA, 18 bp, synthetic construct
  source 1..18: mol_type = other DNA
taaaaaggcacaatatag

SEQ ID NO: 64335 - DNA, 18 bp, synthetic construct
  source 1..18: mol_type = other DNA
taaaaagtatcactaatg

SEQ ID NO: 64336 - DNA, 18 bp, synthetic construct
  source 1..18: mol_type = other DNA
taaaacaactcacttatg

SEQ ID NO: 64337 - DNA, 18 bp, synthetic construct
  source 1..18: mol_type = other DNA
taaaacaactctctagtg

SEQ ID NO: 64338 - DNA, 18 bp, synthetic construct
  source 1..18: mol_type = other DNA
taaaacatctaattggcg

SEQ ID NO: 64339 - DNA, 18 bp, synthetic construct
  source 1..18: mol_type = other DNA
taaaacatttcccctaag

SEQ ID NO: 64340 - DNA, 18 bp, synthetic construct
  source 1..18: mol_type = other DNA
taaaacctccgactattg

SEQ ID NO: 64341 - DNA, 18 bp, synthetic construct
  source 1..18: mol_type = other DNA
taaaacctctcataatag

SEQ ID NO: 64342 - DNA, 18 bp, synthetic construct
  source 1..18: mol_type = other DNA
taaaacctttcactttag

SEQ ID NO: 64343 - DNA, 18 bp, synthetic construct
  source 1..18: mol_type = other DNA
taaaacgaaccactaccg

SEQ ID NO: 64344 - DNA, 18 bp, synthetic construct
  source 1..18: mol_type = other DNA
taaaacgaatacttatag

SEQ ID NO: 64345 - DNA, 18 bp, synthetic construct
  source 1..18: mol_type = other DNA
taaaacgaatctacatag

SEQ ID NO: 64346 - DNA, 18 bp, synthetic construct
  source 1..18: mol_type = other DNA
taaaacgacgcaataacg

SEQ ID NO: 64347 - DNA, 18 bp, synthetic construct
  source 1..18: mol_type = other DNA
taaaacgactgttaaaag

SEQ ID NO: 64348 - DNA, 18 bp, synthetic construct
  source 1..18: mol_type = other DNA
taaaacgattcacatcag

SEQ ID NO: 64349 - DNA, 18 bp, synthetic construct
  source 1..18: mol_type = other DNA
taaaacgccttacactag

SEQ ID NO: 64350 - DNA, 18 bp, synthetic construct
  source 1..18: mol_type = other DNA
taaaacgcgtcgatacag

SEQ ID NO: 64351 - DNA, 18 bp, synthetic construct
  source 1..18: mol_type = other DNA
taaaacgcttagctatag

SEQ ID NO: 64352 - DNA, 18 bp, synthetic construct
  source 1..18: mol_type = other DNA
taaaacgcttcattaatg

SEQ ID NO: 64353 - DNA, 18 bp, synthetic construct
  source 1..18: mol_type = other DNA
taaaacggctcatattag

SEQ ID NO: 64354 - DNA, 18 bp, synthetic construct
  source 1..18: mol_type = other DNA
taaaacgtcaccctaaag

SEQ ID NO: 64355 - DNA, 18 bp, synthetic construct
  source 1..18: mol_type = other DNA
taaaacgtcttattaaag

SEQ ID NO: 64356 - DNA, 18 bp, synthetic construct
  source 1..18: mol_type = other DNA
taaaacgttaacctatag

SEQ ID NO: 64357 - DNA, 18 bp, synthetic construct
  source 1..18: mol_type = other DNA
taaaacgtttcacttcag

SEQ ID NO: 64358 - DNA, 18 bp, synthetic construct
  source 1..18: mol_type = other DNA
taaaactacacacgttag

SEQ ID NO: 64359 - DNA, 18 bp, synthetic construct
  source 1..18: mol_type = other DNA
taaaactacccagaatag

SEQ ID NO: 64360 - DNA, 18 bp, synthetic construct
  source 1..18: mol_type = other DNA
taaaactatcctttattg

SEQ ID NO: 64361 - DNA, 18 bp, synthetic construct
  source 1..18: mol_type = other DNA
taaaactattaaatattg

SEQ ID NO: 64362 - DNA, 18 bp, synthetic construct
  source 1..18: mol_type = other DNA
taaaactattccctattg

SEQ ID NO: 64363 - DNA, 18 bp, synthetic construct
  source 1..18: mol_type = other DNA
taaaactcctcacactag

SEQ ID NO: 64364 - DNA, 18 bp, synthetic construct
  source 1..18: mol_type = other DNA
taaaacttatcacaatag

SEQ ID NO: 64365 - DNA, 18 bp, synthetic construct
  source 1..18: mol_type = other DNA
taaaacttcacaatattg

SEQ ID NO: 64366 - DNA, 18 bp, synthetic construct
  source 1..18: mol_type = other DNA
taaaacttcccattctag

SEQ ID NO: 64367 - DNA, 18 bp, synthetic construct
  source 1..18: mol_type = other DNA
taaaacttctttctatag

SEQ ID NO: 64368 - DNA, 18 bp, synthetic construct
  source 1..18: mol_type = other DNA
taaaagaactcacaaaag

SEQ ID NO: 64369 - DNA, 18 bp, synthetic construct
  source 1..18: mol_type = other DNA
taaaaggactcaataagg

SEQ ID NO: 64370 - DNA, 18 bp, synthetic construct
  source 1..18: mol_type = other DNA
taaaaggattcacttttg

SEQ ID NO: 64371 - DNA, 18 bp, synthetic construct
  source 1..18: mol_type = other DNA
taaaagggctaactaaag

SEQ ID NO: 64372 - DNA, 18 bp, synthetic construct
  source 1..18: mol_type = other DNA
taaaaggtcacagaatag

SEQ ID NO: 64373 - DNA, 18 bp, synthetic construct
  source 1..18: mol_type = other DNA
taaaataattccccatag

SEQ ID NO: 64374 - DNA, 18 bp, synthetic construct
  source 1..18: mol_type = other DNA
taaaatgaccttttatag

SEQ ID NO: 64375 - DNA, 18 bp, synthetic construct
  source 1..18: mol_type = other DNA
taaaatgactctctaagg

SEQ ID NO: 64376 - DNA, 18 bp, synthetic construct
  source 1..18: mol_type = other DNA
taaaatgtttcacttttg

SEQ ID NO: 64377 - DNA, 18 bp, synthetic construct
  source 1..18: mol_type = other DNA
taaaattactctctaaag

SEQ ID NO: 64378 - DNA, 18 bp, synthetic construct
  source 1..18: mol_type = other DNA
taaaattactctcttgag

SEQ ID NO: 64379 - DNA, 18 bp, synthetic construct
  source 1..18: mol_type = other DNA
taaaccgacacacaaaag

SEQ ID NO: 64380 - DNA, 18 bp, synthetic construct
  source 1..18: mol_type = other DNA
taaaccgcctcaccattg

SEQ ID NO: 64381 - DNA, 18 bp, synthetic construct
  source 1..18: mol_type = other DNA
taaaccgtcatactatag

SEQ ID NO: 64382 - DNA, 18 bp, synthetic construct
  source 1..18: mol_type = other DNA
taaaccgtctgcctatag

SEQ ID NO: 64383 - DNA, 18 bp, synthetic construct
  source 1..18: mol_type = other DNA
taaaccgtttttctatag

SEQ ID NO: 64384 - DNA, 18 bp, synthetic construct
  source 1..18: mol_type = other DNA
taaacctactgtctatag

SEQ ID NO: 64385 - DNA, 18 bp, synthetic construct
  source 1..18: mol_type = other DNA
taaacctattcactacag

SEQ ID NO: 64386 - DNA, 18 bp, synthetic construct
  source 1..18: mol_type = other DNA
taaacctgctcaatatcg

SEQ ID NO: 64387 - DNA, 18 bp, synthetic construct
  source 1..18: mol_type = other DNA
taaaccttatcactatcg

SEQ ID NO: 64388 - DNA, 18 bp, synthetic construct
  source 1..18: mol_type = other DNA
taaacggccacacttcag

SEQ ID NO: 64389 - DNA, 18 bp, synthetic construct
  source 1..18: mol_type = other DNA
taaagagtctcactaacg

SEQ ID NO: 64390 - DNA, 18 bp, synthetic construct
  source 1..18: mol_type = other DNA
taaagcgttacactttag

SEQ ID NO: 64391 - DNA, 18 bp, synthetic construct
  source 1..18: mol_type = other DNA
taaaggtactctcgatag

SEQ ID NO: 64392 - DNA, 18 bp, synthetic construct
  source 1..18: mol_type = other DNA
taaatagtctcactatcg

SEQ ID NO: 64393 - DNA, 18 bp, synthetic construct
  source 1..18: mol_type = other DNA
taaatagtcttatcaaag

SEQ ID NO: 64394 - DNA, 18 bp, synthetic construct
  source 1..18: mol_type = other DNA
taaatatactcaataaag

SEQ ID NO: 64395 - DNA, 18 bp, synthetic construct
  source 1..18: mol_type = other DNA
taaatcgaaacattaacg

SEQ ID NO: 64396 - DNA, 18 bp, synthetic construct
  source 1..18: mol_type = other DNA
taaatcgacaaacaatag

SEQ ID NO: 64397 - DNA, 18 bp, synthetic construct
  source 1..18: mol_type = other DNA
taaatcgactcacatcag

SEQ ID NO: 64398 - DNA, 18 bp, synthetic construct
  source 1..18: mol_type = other DNA
taaatcgactcacttagg

SEQ ID NO: 64399 - DNA, 18 bp, synthetic construct
  source 1..18: mol_type = other DNA
taaatcgactcaggcaag

SEQ ID NO: 64400 - DNA, 18 bp, synthetic construct
  source 1..18: mol_type = other DNA
taaatcgactcataaaag

SEQ ID NO: 64401 - DNA, 18 bp, synthetic construct
  source 1..18: mol_type = other DNA
taaatcgactcgtttttg

SEQ ID NO: 64402 - DNA, 18 bp, synthetic construct
  source 1..18: mol_type = other DNA
taaatcgattaactctag

SEQ ID NO: 64403 - DNA, 18 bp, synthetic construct
  source 1..18: mol_type = other DNA
taaatctacgcactttag

SEQ ID NO: 64404 - DNA, 18 bp, synthetic construct
  source 1..18: mol_type = other DNA
taaatggactaacttgag

SEQ ID NO: 64405 - DNA, 18 bp, synthetic construct
  source 1..18: mol_type = other DNA
taaatggactcattgaag

SEQ ID NO: 64406 - DNA, 18 bp, synthetic construct
  source 1..18: mol_type = other DNA
taaattgactccttatag

SEQ ID NO: 64407 - DNA, 18 bp, synthetic construct
  source 1..18: mol_type = other DNA
taacaaagctcataatag

SEQ ID NO: 64408 - DNA, 18 bp, synthetic construct
  source 1..18: mol_type = other DNA
taacaagaccaagtttag

SEQ ID NO: 64409 - DNA, 18 bp, synthetic construct
  source 1..18: mol_type = other DNA
taacaagattccttttag

SEQ ID NO: 64410 - DNA, 18 bp, synthetic construct
  source 1..18: mol_type = other DNA
taacaagctacactttgg

SEQ ID NO: 64411 - DNA, 18 bp, synthetic construct
  source 1..18: mol_type = other DNA
taacacaaataactacag

SEQ ID NO: 64412 - DNA, 18 bp, synthetic construct
  source 1..18: mol_type = other DNA
taacacataacactatag

SEQ ID NO: 64413 - DNA, 18 bp, synthetic construct
  source 1..18: mol_type = other DNA
taacacatctaactatcg

SEQ ID NO: 64414 - DNA, 18 bp, synthetic construct
  source 1..18: mol_type = other DNA
taacacatctcattctag

SEQ ID NO: 64415 - DNA, 18 bp, synthetic construct
  source 1..18: mol_type = other DNA
taacacatctcccaatgg

SEQ ID NO: 64416 - DNA, 18 bp, synthetic construct
  source 1..18: mol_type = other DNA
taacaccactaaaaaatg

SEQ ID NO: 64417 - DNA, 18 bp, synthetic construct
  source 1..18: mol_type = other DNA
taacacgaagcaaagaag

SEQ ID NO: 64418 - DNA, 18 bp, synthetic construct
  source 1..18: mol_type = other DNA
taacacgacacattgcaa

SEQ ID NO: 64419 - DNA, 18 bp, synthetic construct
  source 1..18: mol_type = other DNA
taacacgacagacttaag

SEQ ID NO: 64420 - DNA, 18 bp, synthetic construct
  source 1..18: mol_type = other DNA
taacacgacggacttcag

SEQ ID NO: 64421 - DNA, 18 bp, synthetic construct
  source 1..18: mol_type = other DNA
taacacgactatcaattg

SEQ ID NO: 64422 - DNA, 18 bp, synthetic construct
  source 1..18: mol_type = other DNA
taacacgactcaacaacg

SEQ ID NO: 64423 - DNA, 18 bp, synthetic construct
  source 1..18: mol_type = other DNA
taacacgactccatgttg

SEQ ID NO: 64424 - DNA, 18 bp, synthetic construct
  source 1..18: mol_type = other DNA
taacacgactctttaacg

SEQ ID NO: 64425 - DNA, 18 bp, synthetic construct
  source 1..18: mol_type = other DNA
taacacgagtctatgtag

SEQ ID NO: 64426 - DNA, 18 bp, synthetic construct
  source 1..18: mol_type = other DNA
taacacgatacgctattg

SEQ ID NO: 64427 - DNA, 18 bp, synthetic construct
  source 1..18: mol_type = other DNA
taacacgattctctaatg

SEQ ID NO: 64428 - DNA, 18 bp, synthetic construct
  source 1..18: mol_type = other DNA
taacacgattctttctag

SEQ ID NO: 64429 - DNA, 18 bp, synthetic construct
  source 1..18: mol_type = other DNA
taacacgccttaccctag

SEQ ID NO: 64430 - DNA, 18 bp, synthetic construct
  source 1..18: mol_type = other DNA
taacacgtcttgcaatag

SEQ ID NO: 64431 - DNA, 18 bp, synthetic construct
  source 1..18: mol_type = other DNA
taacactaaccactgtag

SEQ ID NO: 64432 - DNA, 18 bp, synthetic construct
  source 1..18: mol_type = other DNA
taacactacacaccaagg

SEQ ID NO: 64433 - DNA, 18 bp, synthetic construct
  source 1..18: mol_type = other DNA
taacactagtcactcccg

SEQ ID NO: 64434 - DNA, 18 bp, synthetic construct
  source 1..18: mol_type = other DNA
taacacttttcattatag

SEQ ID NO: 64435 - DNA, 18 bp, synthetic construct
  source 1..18: mol_type = other DNA
taacagcaatcactgtag

SEQ ID NO: 64436 - DNA, 18 bp, synthetic construct
  source 1..18: mol_type = other DNA
taacaggactatccatag

SEQ ID NO: 64437 - DNA, 18 bp, synthetic construct
  source 1..18: mol_type = other DNA
taacaggactgtctatcg

SEQ ID NO: 64438 - DNA, 18 bp, synthetic construct
  source 1..18: mol_type = other DNA
taacataaccaactaaag

SEQ ID NO: 64439 - DNA, 18 bp, synthetic construct
  source 1..18: mol_type = other DNA
taacatgacacataatag

SEQ ID NO: 64440 - DNA, 18 bp, synthetic construct
  source 1..18: mol_type = other DNA
taacatgtctctttatag

SEQ ID NO: 64441 - DNA, 18 bp, synthetic construct
  source 1..18: mol_type = other DNA
taacattactctcttagg

SEQ ID NO: 64442 - DNA, 18 bp, synthetic construct
  source 1..18: mol_type = other DNA
taacccgacgctatatag

SEQ ID NO: 64443 - DNA, 18 bp, synthetic construct
  source 1..18: mol_type = other DNA
taacctgatccaccaaag

SEQ ID NO: 64444 - DNA, 18 bp, synthetic construct
  source 1..18: mol_type = other DNA
taacgcgagacactttag

SEQ ID NO: 64445 - DNA, 18 bp, synthetic construct
  source 1..18: mol_type = other DNA
taacgcggcttaggatag

SEQ ID NO: 64446 - DNA, 18 bp, synthetic construct
  source 1..18: mol_type = other DNA
taacgtatctcacacttg

SEQ ID NO: 64447 - DNA, 18 bp, synthetic construct
  source 1..18: mol_type = other DNA
taactagccacactacag

SEQ ID NO: 64448 - DNA, 18 bp, synthetic construct
  source 1..18: mol_type = other DNA
taactcaactcactcaag

SEQ ID NO: 64449 - DNA, 18 bp, synthetic construct
  source 1..18: mol_type = other DNA
taactcaccatacaaaag

SEQ ID NO: 64450 - DNA, 18 bp, synthetic construct
  source 1..18: mol_type = other DNA
taactcacttgtcgttag

SEQ ID NO: 64451 - DNA, 18 bp, synthetic construct
  source 1..18: mol_type = other DNA
taactcctcttacactag

SEQ ID NO: 64452 - DNA, 18 bp, synthetic construct
  source 1..18: mol_type = other DNA
taactcgacactcgatag

SEQ ID NO: 64453 - DNA, 18 bp, synthetic construct
  source 1..18: mol_type = other DNA
taactcgactcacgaatg

SEQ ID NO: 64454 - DNA, 18 bp, synthetic construct
  source 1..18: mol_type = other DNA
taactcgactgacgttag

SEQ ID NO: 64455 - DNA, 18 bp, synthetic construct
  source 1..18: mol_type = other DNA
taactcgccacattacag

SEQ ID NO: 64456 - DNA, 18 bp, synthetic construct
  source 1..18: mol_type = other DNA
taactcgtcccactagcg

SEQ ID NO: 64457 - DNA, 18 bp, synthetic construct
  source 1..18: mol_type = other DNA
taactcttctaaatttag

SEQ ID NO: 64458 - DNA, 18 bp, synthetic construct
  source 1..18: mol_type = other DNA
taactcttctcacaatag

SEQ ID NO: 64459 - DNA, 18 bp, synthetic construct
  source 1..18: mol_type = other DNA
taagaagatttacaatag

SEQ ID NO: 64460 - DNA, 18 bp, synthetic construct
  source 1..18: mol_type = other DNA
taagacaattcacttaag

SEQ ID NO: 64461 - DNA, 18 bp, synthetic construct
  source 1..18: mol_type = other DNA
taagaccattatcaatgg

SEQ ID NO: 64462 - DNA, 18 bp, synthetic construct
  source 1..18: mol_type = other DNA
taagacgacatacttaag

SEQ ID NO: 64463 - DNA, 18 bp, synthetic construct
  source 1..18: mol_type = other DNA
taagacgactcttattag

SEQ ID NO: 64464 - DNA, 18 bp, synthetic construct
  source 1..18: mol_type = other DNA
taagacgatccccagtag

SEQ ID NO: 64465 - DNA, 18 bp, synthetic construct
  source 1..18: mol_type = other DNA
taagacgatttagtttag

SEQ ID NO: 64466 - DNA, 18 bp, synthetic construct
  source 1..18: mol_type = other DNA
taagacgatttccaatag

SEQ ID NO: 64467 - DNA, 18 bp, synthetic construct
  source 1..18: mol_type = other DNA
taagacgcctcacttctg

SEQ ID NO: 64468 - DNA, 18 bp, synthetic construct
  source 1..18: mol_type = other DNA
taagacggctcatagaag

SEQ ID NO: 64469 - DNA, 18 bp, synthetic construct
  source 1..18: mol_type = other DNA
taagactattcacttttg

SEQ ID NO: 64470 - DNA, 18 bp, synthetic construct
  source 1..18: mol_type = other DNA
taagagaacattctatag

SEQ ID NO: 64471 - DNA, 18 bp, synthetic construct
  source 1..18: mol_type = other DNA
taagagggctttatatag

SEQ ID NO: 64472 - DNA, 18 bp, synthetic construct
  source 1..18: mol_type = other DNA
taagatcaattactaaag

SEQ ID NO: 64473 - DNA, 18 bp, synthetic construct
  source 1..18: mol_type = other DNA
taagatgagcccatatag

SEQ ID NO: 64474 - DNA, 18 bp, synthetic construct
  source 1..18: mol_type = other DNA
taagtccactctattgtg

SEQ ID NO: 64475 - DNA, 18 bp, synthetic construct
  source 1..18: mol_type = other DNA
taagtcgtataactgtag

SEQ ID NO: 64476 - DNA, 18 bp, synthetic construct
  source 1..18: mol_type = other DNA
taagtcgtttcaatatag

SEQ ID NO: 64477 - DNA, 18 bp, synthetic construct
  source 1..18: mol_type = other DNA
taagtctacaccttatcg

SEQ ID NO: 64478 - DNA, 18 bp, synthetic construct
  source 1..18: mol_type = other DNA
taagtgtagtcacttttg

SEQ ID NO: 64479 - DNA, 18 bp, synthetic construct
  source 1..18: mol_type = other DNA
taagttgattcattatag

SEQ ID NO: 64480 - DNA, 18 bp, synthetic construct
  source 1..18: mol_type = other DNA
taagttgtcacactaatg

SEQ ID NO: 64481 - DNA, 18 bp, synthetic construct
  source 1..18: mol_type = other DNA
taataaaaatctcaatag

SEQ ID NO: 64482 - DNA, 18 bp, synthetic construct
  source 1..18: mol_type = other DNA
taataaaacgctccatag

SEQ ID NO: 64483 - DNA, 18 bp, synthetic construct
  source 1..18: mol_type = other DNA
taataacaacctcaatag

SEQ ID NO: 64484 - DNA, 18 bp, synthetic construct
  source 1..18: mol_type = other DNA
taataacactcacttatg

SEQ ID NO: 64485 - DNA, 18 bp, synthetic construct
  source 1..18: mol_type = other DNA
taataacattcacattag

SEQ ID NO: 64486 - DNA, 18 bp, synthetic construct
  source 1..18: mol_type = other DNA
taataagaatcaaattag

SEQ ID NO: 64487 - DNA, 18 bp, synthetic construct
  source 1..18: mol_type = other DNA
taataagaatcccaaaag

SEQ ID NO: 64488 - DNA, 18 bp, synthetic construct
  source 1..18: mol_type = other DNA
taataagacacaataatg

SEQ ID NO: 64489 - DNA, 18 bp, synthetic construct
  source 1..18: mol_type = other DNA
taataagacagtttatag

SEQ ID NO: 64490 - DNA, 18 bp, synthetic construct
  source 1..18: mol_type = other DNA
taataagaccaatataag

SEQ ID NO: 64491 - DNA, 18 bp, synthetic construct
  source 1..18: mol_type = other DNA
taataagacccgcaatgg

SEQ ID NO: 64492 - DNA, 18 bp, synthetic construct
  source 1..18: mol_type = other DNA
taataagaccgattaaag

SEQ ID NO: 64493 - DNA, 18 bp, synthetic construct
  source 1..18: mol_type = other DNA
taataagactctgcttag

SEQ ID NO: 64494 - DNA, 18 bp, synthetic construct
  source 1..18: mol_type = other DNA
taataagactgacaactg

SEQ ID NO: 64495 - DNA, 18 bp, synthetic construct
  source 1..18: mol_type = other DNA
taataagacttcccattg

SEQ ID NO: 64496 - DNA, 18 bp, synthetic construct
  source 1..18: mol_type = other DNA
taataagattcccattag

SEQ ID NO: 64497 - DNA, 18 bp, synthetic construct
  source 1..18: mol_type = other DNA
taataagcctgaattaag

SEQ ID NO: 64498 - DNA, 18 bp, synthetic construct
  source 1..18: mol_type = other DNA
taataagtcggtctatag

SEQ ID NO: 64499 - DNA, 18 bp, synthetic construct
  source 1..18: mol_type = other DNA
taataatacactccaacg

SEQ ID NO: 64500 - DNA, 18 bp, synthetic construct
  source 1..18: mol_type = other DNA
taataatactcagtactg

SEQ ID NO: 64501 - DNA, 18 bp, synthetic construct
  source 1..18: mol_type = other DNA
taataatacttaatatgg

SEQ ID NO: 64502 - DNA, 18 bp, synthetic construct
  source 1..18: mol_type = other DNA
taataattcgctcataag

SEQ ID NO: 64503 - DNA, 18 bp, synthetic construct
  source 1..18: mol_type = other DNA
taataattctaattattg

SEQ ID NO: 64504 - DNA, 18 bp, synthetic construct
  source 1..18: mol_type = other DNA
taataattctcacaattg

SEQ ID NO: 64505 - DNA, 18 bp, synthetic construct
  source 1..18: mol_type = other DNA
taatacaacactccttag

SEQ ID NO: 64506 - DNA, 18 bp, synthetic construct
  source 1..18: mol_type = other DNA
taatacaactcaattacg

SEQ ID NO: 64507 - DNA, 18 bp, synthetic construct
  source 1..18: mol_type = other DNA
taatacaacttacttacg

SEQ ID NO: 64508 - DNA, 18 bp, synthetic construct
  source 1..18: mol_type = other DNA
taatacaataaactatgg

SEQ ID NO: 64509 - DNA, 18 bp, synthetic construct
  source 1..18: mol_type = other DNA
taatacaatatacgatag

SEQ ID NO: 64510 - DNA, 18 bp, synthetic construct
  source 1..18: mol_type = other DNA
taatacaatgtcctatag

SEQ ID NO: 64511 - DNA, 18 bp, synthetic construct
  source 1..18: mol_type = other DNA
taatacaattcgctaagg

SEQ ID NO: 64512 - DNA, 18 bp, synthetic construct
  source 1..18: mol_type = other DNA
taatacaattttcttcag

SEQ ID NO: 64513 - DNA, 18 bp, synthetic construct
  source 1..18: mol_type = other DNA
taatacaccacactaagg

SEQ ID NO: 64514 - DNA, 18 bp, synthetic construct
  source 1..18: mol_type = other DNA
taatacaccagactccag

SEQ ID NO: 64515 - DNA, 18 bp, synthetic construct
  source 1..18: mol_type = other DNA
taatacacctcagtaatg

SEQ ID NO: 64516 - DNA, 18 bp, synthetic construct
  source 1..18: mol_type = other DNA
taatacacgtcataatag

SEQ ID NO: 64517 - DNA, 18 bp, synthetic construct
  source 1..18: mol_type = other DNA
taatacataacacaatgg

SEQ ID NO: 64518 - DNA, 18 bp, synthetic construct
  source 1..18: mol_type = other DNA
taatacatcacattaatg

SEQ ID NO: 64519 - DNA, 18 bp, synthetic construct
  source 1..18: mol_type = other DNA
taatacatctcacctgag

SEQ ID NO: 64520 - DNA, 18 bp, synthetic construct
  source 1..18: mol_type = other DNA
taatacattaccctatag

SEQ ID NO: 64521 - DNA, 18 bp, synthetic construct
  source 1..18: mol_type = other DNA
taataccaatcatcaacg

SEQ ID NO: 64522 - DNA, 18 bp, synthetic construct
  source 1..18: mol_type = other DNA
taataccaatctctgttg

SEQ ID NO: 64523 - DNA, 18 bp, synthetic construct
  source 1..18: mol_type = other DNA
taataccatacgctaatg

SEQ ID NO: 64524 - DNA, 18 bp, synthetic construct
  source 1..18: mol_type = other DNA
taataccattgtcttaag

SEQ ID NO: 64525 - DNA, 18 bp, synthetic construct
  source 1..18: mol_type = other DNA
taataccattttccatag

SEQ ID NO: 64526 - DNA, 18 bp, synthetic construct
  source 1..18: mol_type = other DNA
taataccgttccttttag

SEQ ID NO: 64527 - DNA, 18 bp, synthetic construct
  source 1..18: mol_type = other DNA
taatacctatctctacag

SEQ ID NO: 64528 - DNA, 18 bp, synthetic construct
  source 1..18: mol_type = other DNA
taatacctcataatatcg

SEQ ID NO: 64529 - DNA, 18 bp, synthetic construct
  source 1..18: mol_type = other DNA
taatacctctgaccatcg

SEQ ID NO: 64530 - DNA, 18 bp, synthetic construct
  source 1..18: mol_type = other DNA
taatacctctgcttgttg

SEQ ID NO: 64531 - DNA, 18 bp, synthetic construct
  source 1..18: mol_type = other DNA
taatacgaaacatttaag

SEQ ID NO: 64532 - DNA, 18 bp, synthetic construct
  source 1..18: mol_type = other DNA
taatacgaaactctcaag

SEQ ID NO: 64533 - DNA, 18 bp, synthetic construct
  source 1..18: mol_type = other DNA
taatacgaaccaccttgg

SEQ ID NO: 64534 - DNA, 18 bp, synthetic construct
  source 1..18: mol_type = other DNA
taatacgaataaagaaag

SEQ ID NO: 64535 - DNA, 18 bp, synthetic construct
  source 1..18: mol_type = other DNA
taatacgaataacataag

SEQ ID NO: 64536 - DNA, 18 bp, synthetic construct
  source 1..18: mol_type = other DNA
taatacgaatatcagttg

SEQ ID NO: 64537 - DNA, 18 bp, synthetic construct
  source 1..18: mol_type = other DNA
taatacgacaccttaatg

SEQ ID NO: 64538 - DNA, 18 bp, synthetic construct
  source 1..18: mol_type = other DNA
taatacgacattcaacag

SEQ ID NO: 64539 - DNA, 18 bp, synthetic construct
  source 1..18: mol_type = other DNA
taatacgacattcttttg

SEQ ID NO: 64540 - DNA, 18 bp, synthetic construct
  source 1..18: mol_type = other DNA
taatacgacattttacag

SEQ ID NO: 64541 - DNA, 18 bp, synthetic construct
  source 1..18: mol_type = other DNA
taatacgaccctaaattg

SEQ ID NO: 64542 - DNA, 18 bp, synthetic construct
  source 1..18: mol_type = other DNA
taatacgactaagttcgg

SEQ ID NO: 64543 - DNA, 18 bp, synthetic construct
  source 1..18: mol_type = other DNA
taatacgactatattcag

SEQ ID NO: 64544 - DNA, 18 bp, synthetic construct
  source 1..18: mol_type = other DNA
taatacgactgtacaaag

SEQ ID NO: 64545 - DNA, 18 bp, synthetic construct
  source 1..18: mol_type = other DNA
taatacgactttaaaaag

SEQ ID NO: 64546 - DNA, 18 bp, synthetic construct
  source 1..18: mol_type = other DNA
taatacgactttccctcg

SEQ ID NO: 64547 - DNA, 18 bp, synthetic construct
  source 1..18: mol_type = other DNA
taatacgagacacaaatg

SEQ ID NO: 64548 - DNA, 18 bp, synthetic construct
  source 1..18: mol_type = other DNA
taatacgagactcgtttg

SEQ ID NO: 64549 - DNA, 18 bp, synthetic construct
  source 1..18: mol_type = other DNA
taatacgagcaattatgg

SEQ ID NO: 64550 - DNA, 18 bp, synthetic construct
  source 1..18: mol_type = other DNA
taatacgagcgtctttag

SEQ ID NO: 64551 - DNA, 18 bp, synthetic construct
  source 1..18: mol_type = other DNA
taatacgaggcaataacg

SEQ ID NO: 64552 - DNA, 18 bp, synthetic construct
  source 1..18: mol_type = other DNA
taatacgagtctaaattg

SEQ ID NO: 64553 - DNA, 18 bp, synthetic construct
  source 1..18: mol_type = other DNA
taatacgagtggttaaag

SEQ ID NO: 64554 - DNA, 18 bp, synthetic construct
  source 1..18: mol_type = other DNA
taatacgatactcgagcg

SEQ ID NO: 64555 - DNA, 18 bp, synthetic construct
  source 1..18: mol_type = other DNA
taatacgatataccatcg

SEQ ID NO: 64556 - DNA, 18 bp, synthetic construct
  source 1..18: mol_type = other DNA
taatacgatatttcatag

SEQ ID NO: 64557 - DNA, 18 bp, synthetic construct
  source 1..18: mol_type = other DNA
taatacgatcaacgattg

SEQ ID NO: 64558 - DNA, 18 bp, synthetic construct
  source 1..18: mol_type = other DNA
taatacgatctgctattg

SEQ ID NO: 64559 - DNA, 18 bp, synthetic construct
  source 1..18: mol_type = other DNA
taatacgattctacattg

SEQ ID NO: 64560 - DNA, 18 bp, synthetic construct
  source 1..18: mol_type = other DNA
taatacgccactcaattg

SEQ ID NO: 64561 - DNA, 18 bp, synthetic construct
  source 1..18: mol_type = other DNA
taatacgccactttgtag

SEQ ID NO: 64562 - DNA, 18 bp, synthetic construct
  source 1..18: mol_type = other DNA
taatacgctcctctattg

SEQ ID NO: 64563 - DNA, 18 bp, synthetic construct
  source 1..18: mol_type = other DNA
taatacggccccaaacag

SEQ ID NO: 64564 - DNA, 18 bp, synthetic construct
  source 1..18: mol_type = other DNA
taatacgggtgaccttag

SEQ ID NO: 64565 - DNA, 18 bp, synthetic construct
  source 1..18: mol_type = other DNA
taatacgggttacttaag

SEQ ID NO: 64566 - DNA, 18 bp, synthetic construct
  source 1..18: mol_type = other DNA
taatacggtactcataag

SEQ ID NO: 64567 - DNA, 18 bp, synthetic construct
  source 1..18: mol_type = other DNA
taatacggtgctatattg

SEQ ID NO: 64568 - DNA, 18 bp, synthetic construct
  source 1..18: mol_type = other DNA
taatacgtataaacatag

SEQ ID NO: 64569 - DNA, 18 bp, synthetic construct
  source 1..18: mol_type = other DNA
taatacgtattactaatg

SEQ ID NO: 64570 - DNA, 18 bp, synthetic construct
  source 1..18: mol_type = other DNA
taatacgtcactttctag

SEQ ID NO: 64571 - DNA, 18 bp, synthetic construct
  source 1..18: mol_type = other DNA
taatacgtcccgctttcg

SEQ ID NO: 64572 - DNA, 18 bp, synthetic construct
  source 1..18: mol_type = other DNA
taatacgtcccttaatag

SEQ ID NO: 64573 - DNA, 18 bp, synthetic construct
  source 1..18: mol_type = other DNA
taatacgtcccttcatag

SEQ ID NO: 64574 - DNA, 18 bp, synthetic construct
  source 1..18: mol_type = other DNA
taatacgtctctatttgg

SEQ ID NO: 64575 - DNA, 18 bp, synthetic construct
  source 1..18: mol_type = other DNA
taatacgtctctcatgtg

SEQ ID NO: 64576 - DNA, 18 bp, synthetic construct
  source 1..18: mol_type = other DNA
taatacgtctctgcgtag

SEQ ID NO: 64577 - DNA, 18 bp, synthetic construct
  source 1..18: mol_type = other DNA
taatacgtctgtttaaag

SEQ ID NO: 64578 - DNA, 18 bp, synthetic construct
  source 1..18: mol_type = other DNA
taatacgtcttaataatg

SEQ ID NO: 64579 - DNA, 18 bp, synthetic construct
  source 1..18: mol_type = other DNA
taatacgtctttcctttg

SEQ ID NO: 64580 - DNA, 18 bp, synthetic construct
  source 1..18: mol_type = other DNA
taatacgtgtcataaagg

SEQ ID NO: 64581 - DNA, 18 bp, synthetic construct
  source 1..18: mol_type = other DNA
taatacgtgtcattacgg

SEQ ID NO: 64582 - DNA, 18 bp, synthetic construct
  source 1..18: mol_type = other DNA
taatacgtttcaaaatcg

SEQ ID NO: 64583 - DNA, 18 bp, synthetic construct
  source 1..18: mol_type = other DNA
taatacgttttacaattg

SEQ ID NO: 64584 - DNA, 18 bp, synthetic construct
  source 1..18: mol_type = other DNA
taatactacatattattg

SEQ ID NO: 64585 - DNA, 18 bp, synthetic construct
  source 1..18: mol_type = other DNA
taatactactaactgagg

SEQ ID NO: 64586 - DNA, 18 bp, synthetic construct
  source 1..18: mol_type = other DNA
taatactactagccaaag

SEQ ID NO: 64587 - DNA, 18 bp, synthetic construct
  source 1..18: mol_type = other DNA
taatactactatctgttg

SEQ ID NO: 64588 - DNA, 18 bp, synthetic construct
  source 1..18: mol_type = other DNA
taatactagactctacag

SEQ ID NO: 64589 - DNA, 18 bp, synthetic construct
  source 1..18: mol_type = other DNA
taatactatactctctag

SEQ ID NO: 64590 - DNA, 18 bp, synthetic construct
  source 1..18: mol_type = other DNA
taatactatgctttacag

SEQ ID NO: 64591 - DNA, 18 bp, synthetic construct
  source 1..18: mol_type = other DNA
taatactccatactacag

SEQ ID NO: 64592 - DNA, 18 bp, synthetic construct
  source 1..18: mol_type = other DNA
taatacttcacacaatgg

SEQ ID NO: 64593 - DNA, 18 bp, synthetic construct
  source 1..18: mol_type = other DNA
taatacttttcactttgg

SEQ ID NO: 64594 - DNA, 18 bp, synthetic construct
  source 1..18: mol_type = other DNA
taatactttttctaatag

SEQ ID NO: 64595 - DNA, 18 bp, synthetic construct
  source 1..18: mol_type = other DNA
taatagcaatctctagag

SEQ ID NO: 64596 - DNA, 18 bp, synthetic construct
  source 1..18: mol_type = other DNA
taataggaatcttgaaag

SEQ ID NO: 64597 - DNA, 18 bp, synthetic construct
  source 1..18: mol_type = other DNA
taataggagtagacacag

SEQ ID NO: 64598 - DNA, 18 bp, synthetic construct
  source 1..18: mol_type = other DNA
taataggatacacttcag

SEQ ID NO: 64599 - DNA, 18 bp, synthetic construct
  source 1..18: mol_type = other DNA
taataggatccacaagag

SEQ ID NO: 64600 - DNA, 18 bp, synthetic construct
  source 1..18: mol_type = other DNA
taataggattcaattaag

SEQ ID NO: 64601 - DNA, 18 bp, synthetic construct
  source 1..18: mol_type = other DNA
taataggtaacactttag

SEQ ID NO: 64602 - DNA, 18 bp, synthetic construct
  source 1..18: mol_type = other DNA
taataggtctcacatttg

SEQ ID NO: 64603 - DNA, 18 bp, synthetic construct
  source 1..18: mol_type = other DNA
taataggtctcatttttg

SEQ ID NO: 64604 - DNA, 18 bp, synthetic construct
  source 1..18: mol_type = other DNA
taatagttctcataattg

SEQ ID NO: 64605 - DNA, 18 bp, synthetic construct
  source 1..18: mol_type = other DNA
taatataacccattaaag

SEQ ID NO: 64606 - DNA, 18 bp, synthetic construct
  source 1..18: mol_type = other DNA
taatataagacactttcg

SEQ ID NO: 64607 - DNA, 18 bp, synthetic construct
  source 1..18: mol_type = other DNA
taatataattcccaatag

SEQ ID NO: 64608 - DNA, 18 bp, synthetic construct
  source 1..18: mol_type = other DNA
taatataccatacaatcg

SEQ ID NO: 64609 - DNA, 18 bp, synthetic construct
  source 1..18: mol_type = other DNA
taatatatcttagtatag

SEQ ID NO: 64610 - DNA, 18 bp, synthetic construct
  source 1..18: mol_type = other DNA
taatatgaaaaacaatag

SEQ ID NO: 64611 - DNA, 18 bp, synthetic construct
  source 1..18: mol_type = other DNA
taatatgacacaccaatg

SEQ ID NO: 64612 - DNA, 18 bp, synthetic construct
  source 1..18: mol_type = other DNA
taatatgacacgcattag

SEQ ID NO: 64613 - DNA, 18 bp, synthetic construct
  source 1..18: mol_type = other DNA
taatatgacgaccaaaag

SEQ ID NO: 64614 - DNA, 18 bp, synthetic construct
  source 1..18: mol_type = other DNA
taatatgacttacagacg

SEQ ID NO: 64615 - DNA, 18 bp, synthetic construct
  source 1..18: mol_type = other DNA
taatatgactttctaatg

SEQ ID NO: 64616 - DNA, 18 bp, synthetic construct
  source 1..18: mol_type = other DNA
taatatgatcctccatag

SEQ ID NO: 64617 - DNA, 18 bp, synthetic construct
  source 1..18: mol_type = other DNA
taatatgattcacatttg

SEQ ID NO: 64618 - DNA, 18 bp, synthetic construct
  source 1..18: mol_type = other DNA
taatatgatttacagtag

SEQ ID NO: 64619 - DNA, 18 bp, synthetic construct
  source 1..18: mol_type = other DNA
taatatgatttgctttag

SEQ ID NO: 64620 - DNA, 18 bp, synthetic construct
  source 1..18: mol_type = other DNA
taatatgccaccctattg

SEQ ID NO: 64621 - DNA, 18 bp, synthetic construct
  source 1..18: mol_type = other DNA
taatatgcctcttcatag

SEQ ID NO: 64622 - DNA, 18 bp, synthetic construct
  source 1..18: mol_type = other DNA
taatatggcttattttag

SEQ ID NO: 64623 - DNA, 18 bp, synthetic construct
  source 1..18: mol_type = other DNA
taatatgtcacttaatag

SEQ ID NO: 64624 - DNA, 18 bp, synthetic construct
  source 1..18: mol_type = other DNA
taatatgtccctttgtag

SEQ ID NO: 64625 - DNA, 18 bp, synthetic construct
  source 1..18: mol_type = other DNA
taatattaatcaatctag

SEQ ID NO: 64626 - DNA, 18 bp, synthetic construct
  source 1..18: mol_type = other DNA
taatattacaccctaacg

SEQ ID NO: 64627 - DNA, 18 bp, synthetic construct
  source 1..18: mol_type = other DNA
taatattacactttaaag

SEQ ID NO: 64628 - DNA, 18 bp, synthetic construct
  source 1..18: mol_type = other DNA
taatattactcatattag

SEQ ID NO: 64629 - DNA, 18 bp, synthetic construct
  source 1..18: mol_type = other DNA
taatcacactcactcaag

SEQ ID NO: 64630 - DNA, 18 bp, synthetic construct
  source 1..18: mol_type = other DNA
taatcacctactctttcg

SEQ ID NO: 64631 - DNA, 18 bp, synthetic construct
  source 1..18: mol_type = other DNA
taatcagaatccctattg

SEQ ID NO: 64632 - DNA, 18 bp, synthetic construct
  source 1..18: mol_type = other DNA
taatcagaatgactttag

SEQ ID NO: 64633 - DNA, 18 bp, synthetic construct
  source 1..18: mol_type = other DNA
taatcagacaaatatcag

SEQ ID NO: 64634 - DNA, 18 bp, synthetic construct
  source 1..18: mol_type = other DNA
taatccacctctcaatcg

SEQ ID NO: 64635 - DNA, 18 bp, synthetic construct
  source 1..18: mol_type = other DNA
taatcccacccgatatag

SEQ ID NO: 64636 - DNA, 18 bp, synthetic construct
  source 1..18: mol_type = other DNA
taatcccactaacataag

SEQ ID NO: 64637 - DNA, 18 bp, synthetic construct
  source 1..18: mol_type = other DNA
taatcccactatcattag

SEQ ID NO: 64638 - DNA, 18 bp, synthetic construct
  source 1..18: mol_type = other DNA
taatcccactcactgatg

SEQ ID NO: 64639 - DNA, 18 bp, synthetic construct
  source 1..18: mol_type = other DNA
taatccgaaactatatgg

SEQ ID NO: 64640 - DNA, 18 bp, synthetic construct
  source 1..18: mol_type = other DNA
taatccgaaactttatag

SEQ ID NO: 64641 - DNA, 18 bp, synthetic construct
  source 1..18: mol_type = other DNA
taatccgaataaccttag

SEQ ID NO: 64642 - DNA, 18 bp, synthetic construct
  source 1..18: mol_type = other DNA
taatccgaatcaccaatg

SEQ ID NO: 64643 - DNA, 18 bp, synthetic construct
  source 1..18: mol_type = other DNA
taatccgactaactcatg

SEQ ID NO: 64644 - DNA, 18 bp, synthetic construct
  source 1..18: mol_type = other DNA
taatccgactatataaag

SEQ ID NO: 64645 - DNA, 18 bp, synthetic construct
  source 1..18: mol_type = other DNA
taatccgactttttgtag

SEQ ID NO: 64646 - DNA, 18 bp, synthetic construct
  source 1..18: mol_type = other DNA
taatccgagtgaaaaaag

SEQ ID NO: 64647 - DNA, 18 bp, synthetic construct
  source 1..18: mol_type = other DNA
taatccgattccttattg

SEQ ID NO: 64648 - DNA, 18 bp, synthetic construct
  source 1..18: mol_type = other DNA
taatccgtatctcattag

SEQ ID NO: 64649 - DNA, 18 bp, synthetic construct
  source 1..18: mol_type = other DNA
taatccgtctaacgctag

SEQ ID NO: 64650 - DNA, 18 bp, synthetic construct
  source 1..18: mol_type = other DNA
taatccgtctcattaatg

SEQ ID NO: 64651 - DNA, 18 bp, synthetic construct
  source 1..18: mol_type = other DNA
taatccgtctcccgtagg

SEQ ID NO: 64652 - DNA, 18 bp, synthetic construct
  source 1..18: mol_type = other DNA
taatccgtttcaccttag

SEQ ID NO: 64653 - DNA, 18 bp, synthetic construct
  source 1..18: mol_type = other DNA
taatccgtttctctttcg

SEQ ID NO: 64654 - DNA, 18 bp, synthetic construct
  source 1..18: mol_type = other DNA
taatcctactctcattag

SEQ ID NO: 64655 - DNA, 18 bp, synthetic construct
  source 1..18: mol_type = other DNA
taatcctactgaagatag

SEQ ID NO: 64656 - DNA, 18 bp, synthetic construct
  source 1..18: mol_type = other DNA
taatcctatacattatag

SEQ ID NO: 64657 - DNA, 18 bp, synthetic construct
  source 1..18: mol_type = other DNA
taatcctgctctgtgtag

SEQ ID NO: 64658 - DNA, 18 bp, synthetic construct
  source 1..18: mol_type = other DNA
taatcggactcaatagtg

SEQ ID NO: 64659 - DNA, 18 bp, synthetic construct
  source 1..18: mol_type = other DNA
taatctgactaatttcag

SEQ ID NO: 64660 - DNA, 18 bp, synthetic construct
  source 1..18: mol_type = other DNA
taatctgactcgttatgg

SEQ ID NO: 64661 - DNA, 18 bp, synthetic construct
  source 1..18: mol_type = other DNA
taatgagactcattcttg

SEQ ID NO: 64662 - DNA, 18 bp, synthetic construct
  source 1..18: mol_type = other DNA
taatgcatcccaggatgg

SEQ ID NO: 64663 - DNA, 18 bp, synthetic construct
  source 1..18: mol_type = other DNA
taatgccaatcacattag

SEQ ID NO: 64664 - DNA, 18 bp, synthetic construct
  source 1..18: mol_type = other DNA
taatgccatttactttag

SEQ ID NO: 64665 - DNA, 18 bp, synthetic construct
  source 1..18: mol_type = other DNA
taatgcctcacactttag

SEQ ID NO: 64666 - DNA, 18 bp, synthetic construct
  source 1..18: mol_type = other DNA
taatgcgaaaaactttag

SEQ ID NO: 64667 - DNA, 18 bp, synthetic construct
  source 1..18: mol_type = other DNA
taatgcgacagtctattg

SEQ ID NO: 64668 - DNA, 18 bp, synthetic construct
  source 1..18: mol_type = other DNA
taatgcgtatcacattag

SEQ ID NO: 64669 - DNA, 18 bp, synthetic construct
  source 1..18: mol_type = other DNA
taatgcgtccacctatag

SEQ ID NO: 64670 - DNA, 18 bp, synthetic construct
  source 1..18: mol_type = other DNA
taatgcgtccttgaattg

SEQ ID NO: 64671 - DNA, 18 bp, synthetic construct
  source 1..18: mol_type = other DNA
taatgcgtctaaatacag

SEQ ID NO: 64672 - DNA, 18 bp, synthetic construct
  source 1..18: mol_type = other DNA
taatgctacgcaccattg

SEQ ID NO: 64673 - DNA, 18 bp, synthetic construct
  source 1..18: mol_type = other DNA
taatgggactccatattg

SEQ ID NO: 64674 - DNA, 18 bp, synthetic construct
  source 1..18: mol_type = other DNA
taatgggtgaccatatag

SEQ ID NO: 64675 - DNA, 18 bp, synthetic construct
  source 1..18: mol_type = other DNA
taatggtacccaccatag

SEQ ID NO: 64676 - DNA, 18 bp, synthetic construct
  source 1..18: mol_type = other DNA
taatgtgacactctttag

SEQ ID NO: 64677 - DNA, 18 bp, synthetic construct
  source 1..18: mol_type = other DNA
taatgtgacatactttag

SEQ ID NO: 64678 - DNA, 18 bp, synthetic construct
  source 1..18: mol_type = other DNA
taatgtgactccccaaag

SEQ ID NO: 64679 - DNA, 18 bp, synthetic construct
  source 1..18: mol_type = other DNA
taatgtgattcattatgg

SEQ ID NO: 64680 - DNA, 18 bp, synthetic construct
  source 1..18: mol_type = other DNA
taatgttactcatttttg

SEQ ID NO: 64681 - DNA, 18 bp, synthetic construct
  source 1..18: mol_type = other DNA
taatgtttcttactttgg

SEQ ID NO: 64682 - DNA, 18 bp, synthetic construct
  source 1..18: mol_type = other DNA
taattaaagtctcaatag

SEQ ID NO: 64683 - DNA, 18 bp, synthetic construct
  source 1..18: mol_type = other DNA
taattacattctctattg

SEQ ID NO: 64684 - DNA, 18 bp, synthetic construct
  source 1..18: mol_type = other DNA
taattagacatactctag

SEQ ID NO: 64685 - DNA, 18 bp, synthetic construct
  source 1..18: mol_type = other DNA
taattagtctcaccattg

SEQ ID NO: 64686 - DNA, 18 bp, synthetic construct
  source 1..18: mol_type = other DNA
taattcaaataacaatag

SEQ ID NO: 64687 - DNA, 18 bp, synthetic construct
  source 1..18: mol_type = other DNA
taattcaaatggcgatag

SEQ ID NO: 64688 - DNA, 18 bp, synthetic construct
  source 1..18: mol_type = other DNA
taattcaacactctttag

SEQ ID NO: 64689 - DNA, 18 bp, synthetic construct
  source 1..18: mol_type = other DNA
taattcaacagtctacag

SEQ ID NO: 64690 - DNA, 18 bp, synthetic construct
  source 1..18: mol_type = other DNA
taattcaactcaccaagg

SEQ ID NO: 64691 - DNA, 18 bp, synthetic construct
  source 1..18: mol_type = other DNA
taattcaactgactaacg

SEQ ID NO: 64692 - DNA, 18 bp, synthetic construct
  source 1..18: mol_type = other DNA
taattcaactgagattcg

SEQ ID NO: 64693 - DNA, 18 bp, synthetic construct
  source 1..18: mol_type = other DNA
taattcaactttctgtag

SEQ ID NO: 64694 - DNA, 18 bp, synthetic construct
  source 1..18: mol_type = other DNA
taattcatacctctttag

SEQ ID NO: 64695 - DNA, 18 bp, synthetic construct
  source 1..18: mol_type = other DNA
taattcatttcactttag

SEQ ID NO: 64696 - DNA, 18 bp, synthetic construct
  source 1..18: mol_type = other DNA
taattccaacctcaatag

SEQ ID NO: 64697 - DNA, 18 bp, synthetic construct
  source 1..18: mol_type = other DNA
taattcctatcattatag

SEQ ID NO: 64698 - DNA, 18 bp, synthetic construct
  source 1..18: mol_type = other DNA
taattcgaaacactaacg

SEQ ID NO: 64699 - DNA, 18 bp, synthetic construct
  source 1..18: mol_type = other DNA
taattcgaatctcttttg

SEQ ID NO: 64700 - DNA, 18 bp, synthetic construct
  source 1..18: mol_type = other DNA
taattcgaattacgattg

SEQ ID NO: 64701 - DNA, 18 bp, synthetic construct
  source 1..18: mol_type = other DNA
taattcgacataatatgg

SEQ ID NO: 64702 - DNA, 18 bp, synthetic construct
  source 1..18: mol_type = other DNA
taattcgactccaaagag

SEQ ID NO: 64703 - DNA, 18 bp, synthetic construct
  source 1..18: mol_type = other DNA
taattcgactttcaaatg

SEQ ID NO: 64704 - DNA, 18 bp, synthetic construct
  source 1..18: mol_type = other DNA
taattcgagtgacactag

SEQ ID NO: 64705 - DNA, 18 bp, synthetic construct
  source 1..18: mol_type = other DNA
taattcgatacacaatcg

SEQ ID NO: 64706 - DNA, 18 bp, synthetic construct
  source 1..18: mol_type = other DNA
taattcgatacatcagag

SEQ ID NO: 64707 - DNA, 18 bp, synthetic construct
  source 1..18: mol_type = other DNA
taattcgatagatcctgg

SEQ ID NO: 64708 - DNA, 18 bp, synthetic construct
  source 1..18: mol_type = other DNA
taattcgatatctttaag

SEQ ID NO: 64709 - DNA, 18 bp, synthetic construct
  source 1..18: mol_type = other DNA
taattcgatgcaaagtag

SEQ ID NO: 64710 - DNA, 18 bp, synthetic construct
  source 1..18: mol_type = other DNA
taattcgcattactctcg

SEQ ID NO: 64711 - DNA, 18 bp, synthetic construct
  source 1..18: mol_type = other DNA
taattcgccaagctatag

SEQ ID NO: 64712 - DNA, 18 bp, synthetic construct
  source 1..18: mol_type = other DNA
taattcgccacagtttag

SEQ ID NO: 64713 - DNA, 18 bp, synthetic construct
  source 1..18: mol_type = other DNA
taattcggaaaacaacag

SEQ ID NO: 64714 - DNA, 18 bp, synthetic construct
  source 1..18: mol_type = other DNA
taattcggcaaactacag

SEQ ID NO: 64715 - DNA, 18 bp, synthetic construct
  source 1..18: mol_type = other DNA
taattcgtaaaacttttg

SEQ ID NO: 64716 - DNA, 18 bp, synthetic construct
  source 1..18: mol_type = other DNA
taattcgtcaacctagag

SEQ ID NO: 64717 - DNA, 18 bp, synthetic construct
  source 1..18: mol_type = other DNA
taattcgtcacacaattg

SEQ ID NO: 64718 - DNA, 18 bp, synthetic construct
  source 1..18: mol_type = other DNA
taattcgtccaaccttag

SEQ ID NO: 64719 - DNA, 18 bp, synthetic construct
  source 1..18: mol_type = other DNA
taattcgtccatctattg

SEQ ID NO: 64720 - DNA, 18 bp, synthetic construct
  source 1..18: mol_type = other DNA
taattcgtctaacagtag

SEQ ID NO: 64721 - DNA, 18 bp, synthetic construct
  source 1..18: mol_type = other DNA
taattcgtctatctaaag

SEQ ID NO: 64722 - DNA, 18 bp, synthetic construct
  source 1..18: mol_type = other DNA
taattctactatttttag

SEQ ID NO: 64723 - DNA, 18 bp, synthetic construct
  source 1..18: mol_type = other DNA
taattctattccaaatag

SEQ ID NO: 64724 - DNA, 18 bp, synthetic construct
  source 1..18: mol_type = other DNA
taattcttatcattatag

SEQ ID NO: 64725 - DNA, 18 bp, synthetic construct
  source 1..18: mol_type = other DNA
taattctttttaaaagag

SEQ ID NO: 64726 - DNA, 18 bp, synthetic construct
  source 1..18: mol_type = other DNA
taattggtatcgtaaaag

SEQ ID NO: 64727 - DNA, 18 bp, synthetic construct
  source 1..18: mol_type = other DNA
taattgtactcaccttgg

SEQ ID NO: 64728 - DNA, 18 bp, synthetic construct
  source 1..18: mol_type = other DNA
taattgttctctctaatg

SEQ ID NO: 64729 - DNA, 18 bp, synthetic construct
  source 1..18: mol_type = other DNA
taattgttgtcactaaag

SEQ ID NO: 64730 - DNA, 18 bp, synthetic construct
  source 1..18: mol_type = other DNA
taatttaattcactcttg

SEQ ID NO: 64731 - DNA, 18 bp, synthetic construct
  source 1..18: mol_type = other DNA
taatttatctcattatcg

SEQ ID NO: 64732 - DNA, 18 bp, synthetic construct
  source 1..18: mol_type = other DNA
taatttgacgcgttatag

SEQ ID NO: 64733 - DNA, 18 bp, synthetic construct
  source 1..18: mol_type = other DNA
taatttgactcatttttg

SEQ ID NO: 64734 - DNA, 18 bp, synthetic construct
  source 1..18: mol_type = other DNA
taatttgactctcaaaag

SEQ ID NO: 64735 - DNA, 18 bp, synthetic construct
  source 1..18: mol_type = other DNA
taatttgactctccaaag

SEQ ID NO: 64736 - DNA, 18 bp, synthetic construct
  source 1..18: mol_type = other DNA
taatttgactctctaatg

SEQ ID NO: 64737 - DNA, 18 bp, synthetic construct
  source 1..18: mol_type = other DNA
taatttgcttttctatag

SEQ ID NO: 64738 - DNA, 18 bp, synthetic construct
  source 1..18: mol_type = other DNA
taatttgtatgattattg

SEQ ID NO: 64739 - DNA, 18 bp, synthetic construct
  source 1..18: mol_type = other DNA
taatttgtctctctattg

SEQ ID NO: 64740 - DNA, 18 bp, synthetic construct
  source 1..18: mol_type = other DNA
taatttgtcttattatag

SEQ ID NO: 64741 - DNA, 18 bp, synthetic construct
  source 1..18: mol_type = other DNA
tacaacgacttaagtagg

SEQ ID NO: 64742 - DNA, 18 bp, synthetic construct
  source 1..18: mol_type = other DNA
tacaacggctcaccaaag

SEQ ID NO: 64743 - DNA, 18 bp, synthetic construct
  source 1..18: mol_type = other DNA
tacaactaaagactatag

SEQ ID NO: 64744 - DNA, 18 bp, synthetic construct
  source 1..18: mol_type = other DNA
tacaactaatctctaatg

SEQ ID NO: 64745 - DNA, 18 bp, synthetic construct
  source 1..18: mol_type = other DNA
tacaactacacacaatag

SEQ ID NO: 64746 - DNA, 18 bp, synthetic construct
  source 1..18: mol_type = other DNA
tacaattactcactaaag

SEQ ID NO: 64747 - DNA, 18 bp, synthetic construct
  source 1..18: mol_type = other DNA
tacagccaatcagattag

SEQ ID NO: 64748 - DNA, 18 bp, synthetic construct
  source 1..18: mol_type = other DNA
tacagctacaatctatag

SEQ ID NO: 64749 - DNA, 18 bp, synthetic construct
  source 1..18: mol_type = other DNA
tacagttactcactatag

SEQ ID NO: 64750 - DNA, 18 bp, synthetic construct
  source 1..18: mol_type = other DNA
tacatcgacacactcttg

SEQ ID NO: 64751 - DNA, 18 bp, synthetic construct
  source 1..18: mol_type = other DNA
tacatcgactcacaaaag

SEQ ID NO: 64752 - DNA, 18 bp, synthetic construct
  source 1..18: mol_type = other DNA
tacattgactcaataaag

SEQ ID NO: 64753 - DNA, 18 bp, synthetic construct
  source 1..18: mol_type = other DNA
taccaagaaacatcaaag

SEQ ID NO: 64754 - DNA, 18 bp, synthetic construct
  source 1..18: mol_type = other DNA
taccacgacccgcttccg

SEQ ID NO: 64755 - DNA, 18 bp, synthetic construct
  source 1..18: mol_type = other DNA
taccacgactcatttaag

SEQ ID NO: 64756 - DNA, 18 bp, synthetic construct
  source 1..18: mol_type = other DNA
taccactactcaataacg

SEQ ID NO: 64757 - DNA, 18 bp, synthetic construct
  source 1..18: mol_type = other DNA
taccgtgactcattatag

SEQ ID NO: 64758 - DNA, 18 bp, synthetic construct
  source 1..18: mol_type = other DNA
tacgtggacacccaatag

SEQ ID NO: 64759 - DNA, 18 bp, synthetic construct
  source 1..18: mol_type = other DNA
tactaatactcatttaag

SEQ ID NO: 64760 - DNA, 18 bp, synthetic construct
  source 1..18: mol_type = other DNA
tactacaacacaaaatag

SEQ ID NO: 64761 - DNA, 18 bp, synthetic construct
  source 1..18: mol_type = other DNA
tactacatctcactaatg

SEQ ID NO: 64762 - DNA, 18 bp, synthetic construct
  source 1..18: mol_type = other DNA
tactaccaccgattaccg

SEQ ID NO: 64763 - DNA, 18 bp, synthetic construct
  source 1..18: mol_type = other DNA
tactaccgttctatatag

SEQ ID NO: 64764 - DNA, 18 bp, synthetic construct
  source 1..18: mol_type = other DNA
tactacgaatcaaaattg

SEQ ID NO: 64765 - DNA, 18 bp, synthetic construct
  source 1..18: mol_type = other DNA
tactacgacccataaaag

SEQ ID NO: 64766 - DNA, 18 bp, synthetic construct
  source 1..18: mol_type = other DNA
tactacgactacctaatg

SEQ ID NO: 64767 - DNA, 18 bp, synthetic construct
  source 1..18: mol_type = other DNA
tactacgactcaatcatg

SEQ ID NO: 64768 - DNA, 18 bp, synthetic construct
  source 1..18: mol_type = other DNA
tactacgatataccaatg

SEQ ID NO: 64769 - DNA, 18 bp, synthetic construct
  source 1..18: mol_type = other DNA
tactacgtcacactaacg

SEQ ID NO: 64770 - DNA, 18 bp, synthetic construct
  source 1..18: mol_type = other DNA
tactacgtctgattttag

SEQ ID NO: 64771 - DNA, 18 bp, synthetic construct
  source 1..18: mol_type = other DNA
tactactactctcataag

SEQ ID NO: 64772 - DNA, 18 bp, synthetic construct
  source 1..18: mol_type = other DNA
tactactactgacgcaag

SEQ ID NO: 64773 - DNA, 18 bp, synthetic construct
  source 1..18: mol_type = other DNA
tactacttattactattg

SEQ ID NO: 64774 - DNA, 18 bp, synthetic construct
  source 1..18: mol_type = other DNA
tactagaacttactcttg

SEQ ID NO: 64775 - DNA, 18 bp, synthetic construct
  source 1..18: mol_type = other DNA
tactaggaccctctatcg

SEQ ID NO: 64776 - DNA, 18 bp, synthetic construct
  source 1..18: mol_type = other DNA
tactataactcacaatcg

SEQ ID NO: 64777 - DNA, 18 bp, synthetic construct
  source 1..18: mol_type = other DNA
tactatgaatcactttgg

SEQ ID NO: 64778 - DNA, 18 bp, synthetic construct
  source 1..18: mol_type = other DNA
tactatgactagcatgag

SEQ ID NO: 64779 - DNA, 18 bp, synthetic construct
  source 1..18: mol_type = other DNA
tactatgtcacaataaag

SEQ ID NO: 64780 - DNA, 18 bp, synthetic construct
  source 1..18: mol_type = other DNA
tactccgcccaactatag

SEQ ID NO: 64781 - DNA, 18 bp, synthetic construct
  source 1..18: mol_type = other DNA
tactgtgacaccctattg

SEQ ID NO: 64782 - DNA, 18 bp, synthetic construct
  source 1..18: mol_type = other DNA
tacttcaactgaatctag

SEQ ID NO: 64783 - DNA, 18 bp, synthetic construct
  source 1..18: mol_type = other DNA
tacttcatctcacaatag

SEQ ID NO: 64784 - DNA, 18 bp, synthetic construct
  source 1..18: mol_type = other DNA
tacttccactaagtatag

SEQ ID NO: 64785 - DNA, 18 bp, synthetic construct
  source 1..18: mol_type = other DNA
tacttcgacacattattg

SEQ ID NO: 64786 - DNA, 18 bp, synthetic construct
  source 1..18: mol_type = other DNA
tacttcgactaacagtag

SEQ ID NO: 64787 - DNA, 18 bp, synthetic construct
  source 1..18: mol_type = other DNA
tacttcgtcaaactattg

SEQ ID NO: 64788 - DNA, 18 bp, synthetic construct
  source 1..18: mol_type = other DNA
tacttctactccctatcg

SEQ ID NO: 64789 - DNA, 18 bp, synthetic construct
  source 1..18: mol_type = other DNA
tacttcttctcactctag

SEQ ID NO: 64790 - DNA, 18 bp, synthetic construct
  source 1..18: mol_type = other DNA
tacttggaccaactgtag

SEQ ID NO: 64791 - DNA, 18 bp, synthetic construct
  source 1..18: mol_type = other DNA
tactttaactcactcttg

SEQ ID NO: 64792 - DNA, 18 bp, synthetic construct
  source 1..18: mol_type = other DNA
tactttcacaccctaaag

SEQ ID NO: 64793 - DNA, 18 bp, synthetic construct
  source 1..18: mol_type = other DNA
tactttgactgcatacag

SEQ ID NO: 64794 - DNA, 18 bp, synthetic construct
  source 1..18: mol_type = other DNA
tagaaagactaaccttag

SEQ ID NO: 64795 - DNA, 18 bp, synthetic construct
  source 1..18: mol_type = other DNA
tagaaagacttgctatag

SEQ ID NO: 64796 - DNA, 18 bp, synthetic construct
  source 1..18: mol_type = other DNA
tagaaaggctcattgaag

SEQ ID NO: 64797 - DNA, 18 bp, synthetic construct
  source 1..18: mol_type = other DNA
tagaacaacacaatatag

SEQ ID NO: 64798 - DNA, 18 bp, synthetic construct
  source 1..18: mol_type = other DNA
tagaacgacttacatttg

SEQ ID NO: 64799 - DNA, 18 bp, synthetic construct
  source 1..18: mol_type = other DNA
tagagattgtcactatag

SEQ ID NO: 64800 - DNA, 18 bp, synthetic construct
  source 1..18: mol_type = other DNA
tagatccactctctatag

SEQ ID NO: 64801 - DNA, 18 bp, synthetic construct
  source 1..18: mol_type = other DNA
tagatggactaactatag

SEQ ID NO: 64802 - DNA, 18 bp, synthetic construct
  source 1..18: mol_type = other DNA
tagcacgaaacacaattg

SEQ ID NO: 64803 - DNA, 18 bp, synthetic construct
  source 1..18: mol_type = other DNA
tagcacgagtcagtattg

SEQ ID NO: 64804 - DNA, 18 bp, synthetic construct
  source 1..18: mol_type = other DNA
taggacaactcagtattg

SEQ ID NO: 64805 - DNA, 18 bp, synthetic construct
  source 1..18: mol_type = other DNA
taggacggctccctttgg

SEQ ID NO: 64806 - DNA, 18 bp, synthetic construct
  source 1..18: mol_type = other DNA
tagtacaaatcattcttg

SEQ ID NO: 64807 - DNA, 18 bp, synthetic construct
  source 1..18: mol_type = other DNA
tagtacaacacattttcg

SEQ ID NO: 64808 - DNA, 18 bp, synthetic construct
  source 1..18: mol_type = other DNA
tagtacaaccgactacag

SEQ ID NO: 64809 - DNA, 18 bp, synthetic construct
  source 1..18: mol_type = other DNA
tagtacaacttcctgtag

SEQ ID NO: 64810 - DNA, 18 bp, synthetic construct
  source 1..18: mol_type = other DNA
tagtacgaatctttattg

SEQ ID NO: 64811 - DNA, 18 bp, synthetic construct
  source 1..18: mol_type = other DNA
tagtacgactctaaagag

SEQ ID NO: 64812 - DNA, 18 bp, synthetic construct
  source 1..18: mol_type = other DNA
tagtacgatacacttcag

SEQ ID NO: 64813 - DNA, 18 bp, synthetic construct
  source 1..18: mol_type = other DNA
tagtacgattctcaattg

SEQ ID NO: 64814 - DNA, 18 bp, synthetic construct
  source 1..18: mol_type = other DNA
tagtacgccacaatctag

SEQ ID NO: 64815 - DNA, 18 bp, synthetic construct
  source 1..18: mol_type = other DNA
tagtacgccttactttcg

SEQ ID NO: 64816 - DNA, 18 bp, synthetic construct
  source 1..18: mol_type = other DNA
tagtacgtctgattacag

SEQ ID NO: 64817 - DNA, 18 bp, synthetic construct
  source 1..18: mol_type = other DNA
tagtacgttttgctatag

SEQ ID NO: 64818 - DNA, 18 bp, synthetic construct
  source 1..18: mol_type = other DNA
tagtactactctataaag

SEQ ID NO: 64819 - DNA, 18 bp, synthetic construct
  source 1..18: mol_type = other DNA
tagtagtagagacaatag

SEQ ID NO: 64820 - DNA, 18 bp, synthetic construct
  source 1..18: mol_type = other DNA
tagtatgactcattcttg

SEQ ID NO: 64821 - DNA, 18 bp, synthetic construct
  source 1..18: mol_type = other DNA
tagtcagactaacaatag

SEQ ID NO: 64822 - DNA, 18 bp, synthetic construct
  source 1..18: mol_type = other DNA
tagtccaagtcacaatag

SEQ ID NO: 64823 - DNA, 18 bp, synthetic construct
  source 1..18: mol_type = other DNA
tagtccggctttctatgg

SEQ ID NO: 64824 - DNA, 18 bp, synthetic construct
  source 1..18: mol_type = other DNA
tagtgcaactaactatcg

SEQ ID NO: 64825 - DNA, 18 bp, synthetic construct
  source 1..18: mol_type = other DNA
tagtgcaattcgttattg

SEQ ID NO: 64826 - DNA, 18 bp, synthetic construct
  source 1..18: mol_type = other DNA
tagtgcgactcacttatg

SEQ ID NO: 64827 - DNA, 18 bp, synthetic construct
  source 1..18: mol_type = other DNA
tagtgcgcgtcattttag

SEQ ID NO: 64828 - DNA, 18 bp, synthetic construct
  source 1..18: mol_type = other DNA
tagtgctttatacccaag

SEQ ID NO: 64829 - DNA, 18 bp, synthetic construct
  source 1..18: mol_type = other DNA
tagtgggattccctactg

SEQ ID NO: 64830 - DNA, 18 bp, synthetic construct
  source 1..18: mol_type = other DNA
tagttacccttagggtag

SEQ ID NO: 64831 - DNA, 18 bp, synthetic construct
  source 1..18: mol_type = other DNA
tagttcgactcgatattg

SEQ ID NO: 64832 - DNA, 18 bp, synthetic construct
  source 1..18: mol_type = other DNA
tagttcgacttcctaaag

SEQ ID NO: 64833 - DNA, 18 bp, synthetic construct
  source 1..18: mol_type = other DNA
tagttcgatttatactag

SEQ ID NO: 64834 - DNA, 18 bp, synthetic construct
  source 1..18: mol_type = other DNA
tagttcgtatcactctag

SEQ ID NO: 64835 - DNA, 18 bp, synthetic construct
  source 1..18: mol_type = other DNA
tagttcgtcatacgatag

SEQ ID NO: 64836 - DNA, 18 bp, synthetic construct
  source 1..18: mol_type = other DNA
tagttcttctatctatag

SEQ ID NO: 64837 - DNA, 18 bp, synthetic construct
  source 1..18: mol_type = other DNA
tagtttgtctcgctatag

SEQ ID NO: 64838 - DNA, 18 bp, synthetic construct
  source 1..18: mol_type = other DNA
tataaaaactcaccattg

SEQ ID NO: 64839 - DNA, 18 bp, synthetic construct
  source 1..18: mol_type = other DNA
tataaatacacaacatag

SEQ ID NO: 64840 - DNA, 18 bp, synthetic construct
  source 1..18: mol_type = other DNA
tataaattattactatag

SEQ ID NO: 64841 - DNA, 18 bp, synthetic construct
  source 1..18: mol_type = other DNA
tataacaagtatctattg

SEQ ID NO: 64842 - DNA, 18 bp, synthetic construct
  source 1..18: mol_type = other DNA
tataacatctatttaaag

SEQ ID NO: 64843 - DNA, 18 bp, synthetic construct
  source 1..18: mol_type = other DNA
tataaccagagacttaag

SEQ ID NO: 64844 - DNA, 18 bp, synthetic construct
  source 1..18: mol_type = other DNA
tataaccagtcacaatag

SEQ ID NO: 64845 - DNA, 18 bp, synthetic construct
  source 1..18: mol_type = other DNA
tataacgaacctctttag

SEQ ID NO: 64846 - DNA, 18 bp, synthetic construct
  source 1..18: mol_type = other DNA
tataacgaatcactaatg

SEQ ID NO: 64847 - DNA, 18 bp, synthetic construct
  source 1..18: mol_type = other DNA
tataacgaatgaatatag

SEQ ID NO: 64848 - DNA, 18 bp, synthetic construct
  source 1..18: mol_type = other DNA
tataacgacagtctacag

SEQ ID NO: 64849 - DNA, 18 bp, synthetic construct
  source 1..18: mol_type = other DNA
tataacgacatcttaaag

SEQ ID NO: 64850 - DNA, 18 bp, synthetic construct
  source 1..18: mol_type = other DNA
tataacgaccctataaag

SEQ ID NO: 64851 - DNA, 18 bp, synthetic construct
  source 1..18: mol_type = other DNA
tataacgactcactgccg

SEQ ID NO: 64852 - DNA, 18 bp, synthetic construct
  source 1..18: mol_type = other DNA
tataacgactccttgtag

SEQ ID NO: 64853 - DNA, 18 bp, synthetic construct
  source 1..18: mol_type = other DNA
tataacgactctccttag

SEQ ID NO: 64854 - DNA, 18 bp, synthetic construct
  source 1..18: mol_type = other DNA
tataacgactctgtaaag

SEQ ID NO: 64855 - DNA, 18 bp, synthetic construct
  source 1..18: mol_type = other DNA
tataacgacttacttcag

SEQ ID NO: 64856 - DNA, 18 bp, synthetic construct
  source 1..18: mol_type = other DNA
tataacgcctcaatgtag

SEQ ID NO: 64857 - DNA, 18 bp, synthetic construct
  source 1..18: mol_type = other DNA
tataacgtttaactatag

SEQ ID NO: 64858 - DNA, 18 bp, synthetic construct
  source 1..18: mol_type = other DNA
tataactaataactatag

SEQ ID NO: 64859 - DNA, 18 bp, synthetic construct
  source 1..18: mol_type = other DNA
tataactactcaccaaag

SEQ ID NO: 64860 - DNA, 18 bp, synthetic construct
  source 1..18: mol_type = other DNA
tataaggagtcacaatag

SEQ ID NO: 64861 - DNA, 18 bp, synthetic construct
  source 1..18: mol_type = other DNA
tataaggcacctctaatg

SEQ ID NO: 64862 - DNA, 18 bp, synthetic construct
  source 1..18: mol_type = other DNA
tataatgtcttacactag

SEQ ID NO: 64863 - DNA, 18 bp, synthetic construct
  source 1..18: mol_type = other DNA
tataccgactcacaattg

SEQ ID NO: 64864 - DNA, 18 bp, synthetic construct
  source 1..18: mol_type = other DNA
tatactgtttcacgttag

SEQ ID NO: 64865 - DNA, 18 bp, synthetic construct
  source 1..18: mol_type = other DNA
tatatatacttacaagag

SEQ ID NO: 64866 - DNA, 18 bp, synthetic construct
  source 1..18: mol_type = other DNA
tatatcgacacactacag

SEQ ID NO: 64867 - DNA, 18 bp, synthetic construct
  source 1..18: mol_type = other DNA
tatatcgactcgctattg

SEQ ID NO: 64868 - DNA, 18 bp, synthetic construct
  source 1..18: mol_type = other DNA
tatatcgacttacttaag

SEQ ID NO: 64869 - DNA, 18 bp, synthetic construct
  source 1..18: mol_type = other DNA
tatatcgattctctagag

SEQ ID NO: 64870 - DNA, 18 bp, synthetic construct
  source 1..18: mol_type = other DNA
tatatcgcctgactatag

SEQ ID NO: 64871 - DNA, 18 bp, synthetic construct
  source 1..18: mol_type = other DNA
tatcaagtgccatccaag

SEQ ID NO: 64872 - DNA, 18 bp, synthetic construct
  source 1..18: mol_type = other DNA
tatcacgacttactgaag

SEQ ID NO: 64873 - DNA, 18 bp, synthetic construct
  source 1..18: mol_type = other DNA
tatcacgcatgacttaag

SEQ ID NO: 64874 - DNA, 18 bp, synthetic construct
  source 1..18: mol_type = other DNA
tatcacgctacacaatgg

SEQ ID NO: 64875 - DNA, 18 bp, synthetic construct
  source 1..18: mol_type = other DNA
tatcacggctcaaaaatg

SEQ ID NO: 64876 - DNA, 18 bp, synthetic construct
  source 1..18: mol_type = other DNA
tatcacgtgacaattatg

SEQ ID NO: 64877 - DNA, 18 bp, synthetic construct
  source 1..18: mol_type = other DNA
tatcactactaattattg

SEQ ID NO: 64878 - DNA, 18 bp, synthetic construct
  source 1..18: mol_type = other DNA
tatcagggctcataatag

SEQ ID NO: 64879 - DNA, 18 bp, synthetic construct
  source 1..18: mol_type = other DNA
tatcatgattcactgaag

SEQ ID NO: 64880 - DNA, 18 bp, synthetic construct
  source 1..18: mol_type = other DNA
tatcccgacatactatag

SEQ ID NO: 64881 - DNA, 18 bp, synthetic construct
  source 1..18: mol_type = other DNA
tatctcgactccgtatag

SEQ ID NO: 64882 - DNA, 18 bp, synthetic construct
  source 1..18: mol_type = other DNA
tatgaattctcacactag

SEQ ID NO: 64883 - DNA, 18 bp, synthetic construct
  source 1..18: mol_type = other DNA
tatgacatctgcctaatg

SEQ ID NO: 64884 - DNA, 18 bp, synthetic construct
  source 1..18: mol_type = other DNA
tatgacgacgctcaatag

SEQ ID NO: 64885 - DNA, 18 bp, synthetic construct
  source 1..18: mol_type = other DNA
tattaaatcttagtatag

SEQ ID NO: 64886 - DNA, 18 bp, synthetic construct
  source 1..18: mol_type = other DNA
tattaagacacattattg

SEQ ID NO: 64887 - DNA, 18 bp, synthetic construct
  source 1..18: mol_type = other DNA
tattaagactcgctcttg

SEQ ID NO: 64888 - DNA, 18 bp, synthetic construct
  source 1..18: mol_type = other DNA
tattaagactctcgttag

SEQ ID NO: 64889 - DNA, 18 bp, synthetic construct
  source 1..18: mol_type = other DNA
tattaagatgcactaatg

SEQ ID NO: 64890 - DNA, 18 bp, synthetic construct
  source 1..18: mol_type = other DNA
tattaagcatggttattg

SEQ ID NO: 64891 - DNA, 18 bp, synthetic construct
  source 1..18: mol_type = other DNA
tattaaggcaaggtattg

SEQ ID NO: 64892 - DNA, 18 bp, synthetic construct
  source 1..18: mol_type = other DNA
tattaagtcatactgttg

SEQ ID NO: 64893 - DNA, 18 bp, synthetic construct
  source 1..18: mol_type = other DNA
tattaagtctgactaaag

SEQ ID NO: 64894 - DNA, 18 bp, synthetic construct
  source 1..18: mol_type = other DNA
tattaatacttactagag

SEQ ID NO: 64895 - DNA, 18 bp, synthetic construct
  source 1..18: mol_type = other DNA
tattaatgcatactaacg

SEQ ID NO: 64896 - DNA, 18 bp, synthetic construct
  source 1..18: mol_type = other DNA
tattacaaaaggctattg

SEQ ID NO: 64897 - DNA, 18 bp, synthetic construct
  source 1..18: mol_type = other DNA
tattacaaatttctattg

SEQ ID NO: 64898 - DNA, 18 bp, synthetic construct
  source 1..18: mol_type = other DNA
tattacaacacacttttg

SEQ ID NO: 64899 - DNA, 18 bp, synthetic construct
  source 1..18: mol_type = other DNA
tattacaacctactgtag

SEQ ID NO: 64900 - DNA, 18 bp, synthetic construct
  source 1..18: mol_type = other DNA
tattacaactaacaagag

SEQ ID NO: 64901 - DNA, 18 bp, synthetic construct
  source 1..18: mol_type = other DNA
tattacaactctgtattg

SEQ ID NO: 64902 - DNA, 18 bp, synthetic construct
  source 1..18: mol_type = other DNA
tattacaattaaccatag

SEQ ID NO: 64903 - DNA, 18 bp, synthetic construct
  source 1..18: mol_type = other DNA
tattaccaagcactactg

SEQ ID NO: 64904 - DNA, 18 bp, synthetic construct
  source 1..18: mol_type = other DNA
tattaccactcatttttg

SEQ ID NO: 64905 - DNA, 18 bp, synthetic construct
  source 1..18: mol_type = other DNA
tattaccattctacatag

SEQ ID NO: 64906 - DNA, 18 bp, synthetic construct
  source 1..18: mol_type = other DNA
tattacctatcactattg

SEQ ID NO: 64907 - DNA, 18 bp, synthetic construct
  source 1..18: mol_type = other DNA
tattacgaaacacaacag

SEQ ID NO: 64908 - DNA, 18 bp, synthetic construct
  source 1..18: mol_type = other DNA
tattacgaatcgctaacg

SEQ ID NO: 64909 - DNA, 18 bp, synthetic construct
  source 1..18: mol_type = other DNA
tattacgaatctccttag

SEQ ID NO: 64910 - DNA, 18 bp, synthetic construct
  source 1..18: mol_type = other DNA
tattacgacccccttaag

SEQ ID NO: 64911 - DNA, 18 bp, synthetic construct
  source 1..18: mol_type = other DNA
tattacgacccgttaaag

SEQ ID NO: 64912 - DNA, 18 bp, synthetic construct
  source 1..18: mol_type = other DNA
tattacgaccttcctttg

SEQ ID NO: 64913 - DNA, 18 bp, synthetic construct
  source 1..18: mol_type = other DNA
tattacgactaatactag

SEQ ID NO: 64914 - DNA, 18 bp, synthetic construct
  source 1..18: mol_type = other DNA
tattacgactgtttacgg

SEQ ID NO: 64915 - DNA, 18 bp, synthetic construct
  source 1..18: mol_type = other DNA
tattacgagtaaccttag

SEQ ID NO: 64916 - DNA, 18 bp, synthetic construct
  source 1..18: mol_type = other DNA
tattacgatagtcacttg

SEQ ID NO: 64917 - DNA, 18 bp, synthetic construct
  source 1..18: mol_type = other DNA
tattacgattcacaactg

SEQ ID NO: 64918 - DNA, 18 bp, synthetic construct
  source 1..18: mol_type = other DNA
tattacgattcacagttg

SEQ ID NO: 64919 - DNA, 18 bp, synthetic construct
  source 1..18: mol_type = other DNA
tattacgcctcatacctg

SEQ ID NO: 64920 - DNA, 18 bp, synthetic construct
  source 1..18: mol_type = other DNA
tattacgctcctctatag

SEQ ID NO: 64921 - DNA, 18 bp, synthetic construct
  source 1..18: mol_type = other DNA
tattacggcacgctctag

SEQ ID NO: 64922 - DNA, 18 bp, synthetic construct
  source 1..18: mol_type = other DNA
tattacggctcacttacg

SEQ ID NO: 64923 - DNA, 18 bp, synthetic construct
  source 1..18: mol_type = other DNA
tattacgtataaaaattg

SEQ ID NO: 64924 - DNA, 18 bp, synthetic construct
  source 1..18: mol_type = other DNA
tattacgtataattgtag

SEQ ID NO: 64925 - DNA, 18 bp, synthetic construct
  source 1..18: mol_type = other DNA
tattacgtcaaactaacg

SEQ ID NO: 64926 - DNA, 18 bp, synthetic construct
  source 1..18: mol_type = other DNA
tattacgtcacacaatcg

SEQ ID NO: 64927 - DNA, 18 bp, synthetic construct
  source 1..18: mol_type = other DNA
tattacgtcactcttttg

SEQ ID NO: 64928 - DNA, 18 bp, synthetic construct
  source 1..18: mol_type = other DNA
tattacgtccctctcttg

SEQ ID NO: 64929 - DNA, 18 bp, synthetic construct
  source 1..18: mol_type = other DNA
tattacgtcgcagaatag

SEQ ID NO: 64930 - DNA, 18 bp, synthetic construct
  source 1..18: mol_type = other DNA
tattacgtctcattgaag

SEQ ID NO: 64931 - DNA, 18 bp, synthetic construct
  source 1..18: mol_type = other DNA
tattacgtcttactcttg

SEQ ID NO: 64932 - DNA, 18 bp, synthetic construct
  source 1..18: mol_type = other DNA
tattacgtcttgctatgg

SEQ ID NO: 64933 - DNA, 18 bp, synthetic construct
  source 1..18: mol_type = other DNA
tattactaactactaatg

SEQ ID NO: 64934 - DNA, 18 bp, synthetic construct
  source 1..18: mol_type = other DNA
tattactaatcacttgtg

SEQ ID NO: 64935 - DNA, 18 bp, synthetic construct
  source 1..18: mol_type = other DNA
tattactacatactattg

SEQ ID NO: 64936 - DNA, 18 bp, synthetic construct
  source 1..18: mol_type = other DNA
tattactactaactaagg

SEQ ID NO: 64937 - DNA, 18 bp, synthetic construct
  source 1..18: mol_type = other DNA
tattactactctctaacg

SEQ ID NO: 64938 - DNA, 18 bp, synthetic construct
  source 1..18: mol_type = other DNA
tattactactctgtactg

SEQ ID NO: 64939 - DNA, 18 bp, synthetic construct
  source 1..18: mol_type = other DNA
tattactattaattatag

SEQ ID NO: 64940 - DNA, 18 bp, synthetic construct
  source 1..18: mol_type = other DNA
tattactcctcacttctg

SEQ ID NO: 64941 - DNA, 18 bp, synthetic construct
  source 1..18: mol_type = other DNA
tattactcctcatcgtag

SEQ ID NO: 64942 - DNA, 18 bp, synthetic construct
  source 1..18: mol_type = other DNA
tattactcctcattacag

SEQ ID NO: 64943 - DNA, 18 bp, synthetic construct
  source 1..18: mol_type = other DNA
tattagagcttactattg

SEQ ID NO: 64944 - DNA, 18 bp, synthetic construct
  source 1..18: mol_type = other DNA
tattagcattctcaatag

SEQ ID NO: 64945 - DNA, 18 bp, synthetic construct
  source 1..18: mol_type = other DNA
tattaggaatcagtattg

SEQ ID NO: 64946 - DNA, 18 bp, synthetic construct
  source 1..18: mol_type = other DNA
tattaggactcgttaaag

SEQ ID NO: 64947 - DNA, 18 bp, synthetic construct
  source 1..18: mol_type = other DNA
tattaggagttactatcg

SEQ ID NO: 64948 - DNA, 18 bp, synthetic construct
  source 1..18: mol_type = other DNA
tattaggcatcactatcg

SEQ ID NO: 64949 - DNA, 18 bp, synthetic construct
  source 1..18: mol_type = other DNA
tattagtactgataattg

SEQ ID NO: 64950 - DNA, 18 bp, synthetic construct
  source 1..18: mol_type = other DNA
tattagtgcttagtattg

SEQ ID NO: 64951 - DNA, 18 bp, synthetic construct
  source 1..18: mol_type = other DNA
tattataactcattattg

SEQ ID NO: 64952 - DNA, 18 bp, synthetic construct
  source 1..18: mol_type = other DNA
tattataattcactttag

SEQ ID NO: 64953 - DNA, 18 bp, synthetic construct
  source 1..18: mol_type = other DNA
tattatcgctcacaatag

SEQ ID NO: 64954 - DNA, 18 bp, synthetic construct
  source 1..18: mol_type = other DNA
tattatgacatacaatgg

SEQ ID NO: 64955 - DNA, 18 bp, synthetic construct
  source 1..18: mol_type = other DNA
tattatgactccctaatg

SEQ ID NO: 64956 - DNA, 18 bp, synthetic construct
  source 1..18: mol_type = other DNA
tattatgactctataaag

SEQ ID NO: 64957 - DNA, 18 bp, synthetic construct
  source 1..18: mol_type = other DNA
tattatgactctttaaag

SEQ ID NO: 64958 - DNA, 18 bp, synthetic construct
  source 1..18: mol_type = other DNA
tattatgatcaactatag

SEQ ID NO: 64959 - DNA, 18 bp, synthetic construct
  source 1..18: mol_type = other DNA
tattatgtcgatctttag

SEQ ID NO: 64960 - DNA, 18 bp, synthetic construct
  source 1..18: mol_type = other DNA
tattattactaactaaag

SEQ ID NO: 64961 - DNA, 18 bp, synthetic construct
  source 1..18: mol_type = other DNA
tattatttctcactatcg

SEQ ID NO: 64962 - DNA, 18 bp, synthetic construct
  source 1..18: mol_type = other DNA
tattccaactatctgaag

SEQ ID NO: 64963 - DNA, 18 bp, synthetic construct
  source 1..18: mol_type = other DNA
tattccaactcacgatcg

SEQ ID NO: 64964 - DNA, 18 bp, synthetic construct
  source 1..18: mol_type = other DNA
tattccgaaacacactag

SEQ ID NO: 64965 - DNA, 18 bp, synthetic construct
  source 1..18: mol_type = other DNA
tattccgaaacagtatag

SEQ ID NO: 64966 - DNA, 18 bp, synthetic construct
  source 1..18: mol_type = other DNA
tattccgtctcaataaag

SEQ ID NO: 64967 - DNA, 18 bp, synthetic construct
  source 1..18: mol_type = other DNA
tattcctactctctctag

SEQ ID NO: 64968 - DNA, 18 bp, synthetic construct
  source 1..18: mol_type = other DNA
tattctgactcaacatag

SEQ ID NO: 64969 - DNA, 18 bp, synthetic construct
  source 1..18: mol_type = other DNA
tattcttattcactatag

SEQ ID NO: 64970 - DNA, 18 bp, synthetic construct
  source 1..18: mol_type = other DNA
tattgagattctcaacag

SEQ ID NO: 64971 - DNA, 18 bp, synthetic construct
  source 1..18: mol_type = other DNA
tattgagtcattctaatg

SEQ ID NO: 64972 - DNA, 18 bp, synthetic construct
  source 1..18: mol_type = other DNA
tattgcaactcacgttag

SEQ ID NO: 64973 - DNA, 18 bp, synthetic construct
  source 1..18: mol_type = other DNA
tattgcaactcactgtcg

SEQ ID NO: 64974 - DNA, 18 bp, synthetic construct
  source 1..18: mol_type = other DNA
tattgccaaacactattg

SEQ ID NO: 64975 - DNA, 18 bp, synthetic construct
  source 1..18: mol_type = other DNA
tattgcgacaaaatatag

SEQ ID NO: 64976 - DNA, 18 bp, synthetic construct
  source 1..18: mol_type = other DNA
tattgcgacccgatatcg

SEQ ID NO: 64977 - DNA, 18 bp, synthetic construct
  source 1..18: mol_type = other DNA
tattgcgactctctaatg

SEQ ID NO: 64978 - DNA, 18 bp, synthetic construct
  source 1..18: mol_type = other DNA
tattgcggcacgcattag

SEQ ID NO: 64979 - DNA, 18 bp, synthetic construct
  source 1..18: mol_type = other DNA
tattgctacacaatttcg

SEQ ID NO: 64980 - DNA, 18 bp, synthetic construct
  source 1..18: mol_type = other DNA
tatttacacacaataaag

SEQ ID NO: 64981 - DNA, 18 bp, synthetic construct
  source 1..18: mol_type = other DNA
tatttagaatcactatcg

SEQ ID NO: 64982 - DNA, 18 bp, synthetic construct
  source 1..18: mol_type = other DNA
tatttagactctcattcg

SEQ ID NO: 64983 - DNA, 18 bp, synthetic construct
  source 1..18: mol_type = other DNA
tatttagacttactaaag

SEQ ID NO: 64984 - DNA, 18 bp, synthetic construct
  source 1..18: mol_type = other DNA
tatttagtctcagtatag

SEQ ID NO: 64985 - DNA, 18 bp, synthetic construct
  source 1..18: mol_type = other DNA
tatttcaactagctatag

SEQ ID NO: 64986 - DNA, 18 bp, synthetic construct
  source 1..18: mol_type = other DNA
tatttcaactcacttagg

SEQ ID NO: 64987 - DNA, 18 bp, synthetic construct
  source 1..18: mol_type = other DNA
tatttcaattaactcaag

SEQ ID NO: 64988 - DNA, 18 bp, synthetic construct
  source 1..18: mol_type = other DNA
tatttcaattaacttcag

SEQ ID NO: 64989 - DNA, 18 bp, synthetic construct
  source 1..18: mol_type = other DNA
tatttccacttattatag

SEQ ID NO: 64990 - DNA, 18 bp, synthetic construct
  source 1..18: mol_type = other DNA
tatttcgaactattaaag

SEQ ID NO: 64991 - DNA, 18 bp, synthetic construct
  source 1..18: mol_type = other DNA
tatttcgaatcacaaaag

SEQ ID NO: 64992 - DNA, 18 bp, synthetic construct
  source 1..18: mol_type = other DNA
tatttcgacataccatcg

SEQ ID NO: 64993 - DNA, 18 bp, synthetic construct
  source 1..18: mol_type = other DNA
tatttcgactcacactcg

SEQ ID NO: 64994 - DNA, 18 bp, synthetic construct
  source 1..18: mol_type = other DNA
tatttcgactcctttttg

SEQ ID NO: 64995 - DNA, 18 bp, synthetic construct
  source 1..18: mol_type = other DNA
tatttcgagacactcaag

SEQ ID NO: 64996 - DNA, 18 bp, synthetic construct
  source 1..18: mol_type = other DNA
tatttcgatacaccatag

SEQ ID NO: 64997 - DNA, 18 bp, synthetic construct
  source 1..18: mol_type = other DNA
tatttcgattaacaatag

SEQ ID NO: 64998 - DNA, 18 bp, synthetic construct
  source 1..18: mol_type = other DNA
tatttcgcctccctattg

SEQ ID NO: 64999 - DNA, 18 bp, synthetic construct
  source 1..18: mol_type = other DNA
tatttcgtatcattatag

SEQ ID NO: 65000 - DNA, 18 bp, synthetic construct
  source 1..18: mol_type = other DNA
tatttctcctcactctag

SEQ ID NO: 65001 - DNA, 18 bp, synthetic construct
  source 1..18: mol_type = other DNA
tatttcttcccactttgg

SEQ ID NO: 65002 - DNA, 18 bp, synthetic construct
  source 1..18: mol_type = other DNA
tattttcactccctattg

SEQ ID NO: 65003 - DNA, 18 bp, synthetic construct
  source 1..18: mol_type = other DNA
tcaaacgaatcaattcag

SEQ ID NO: 65004 - DNA, 18 bp, synthetic construct
  source 1..18: mol_type = other DNA
tcaaacgacacactcttg

SEQ ID NO: 65005 - DNA, 18 bp, synthetic construct
  source 1..18: mol_type = other DNA
tcaaacgactttatatcg

SEQ ID NO: 65006 - DNA, 18 bp, synthetic construct
  source 1..18: mol_type = other DNA
tcaaacgcttcactatgg

SEQ ID NO: 65007 - DNA, 18 bp, synthetic construct
  source 1..18: mol_type = other DNA
tcaaacgtcccaaaaggg

SEQ ID NO: 65008 - DNA, 18 bp, synthetic construct
  source 1..18: mol_type = other DNA
tcaaacgtctaactatgg

SEQ ID NO: 65009 - DNA, 18 bp, synthetic construct
  source 1..18: mol_type = other DNA
tcaaacgtgccacaatag

SEQ ID NO: 65010 - DNA, 18 bp, synthetic construct
  source 1..18: mol_type = other DNA
tcaaacttcttacttaag

SEQ ID NO: 65011 - DNA, 18 bp, synthetic construct
  source 1..18: mol_type = other DNA
tcaaatgtctcattatag

SEQ ID NO: 65012 - DNA, 18 bp, synthetic construct
  source 1..18: mol_type = other DNA
tcaactgtctcgctccag

SEQ ID NO: 65013 - DNA, 18 bp, synthetic construct
  source 1..18: mol_type = other DNA
tcaagcctctccctatag

SEQ ID NO: 65014 - DNA, 18 bp, synthetic construct
  source 1..18: mol_type = other DNA
tcaagctccactctaaag

SEQ ID NO: 65015 - DNA, 18 bp, synthetic construct
  source 1..18: mol_type = other DNA
tcaatccatttactaatg

SEQ ID NO: 65016 - DNA, 18 bp, synthetic construct
  source 1..18: mol_type = other DNA
tcaatcgaatttctctag

SEQ ID NO: 65017 - DNA, 18 bp, synthetic construct
  source 1..18: mol_type = other DNA
tcaatcgactcacataag

SEQ ID NO: 65018 - DNA, 18 bp, synthetic construct
  source 1..18: mol_type = other DNA
tcaatcgattcgctatag

SEQ ID NO: 65019 - DNA, 18 bp, synthetic construct
  source 1..18: mol_type = other DNA
tcaatcgtcttacaatag

SEQ ID NO: 65020 - DNA, 18 bp, synthetic construct
  source 1..18: mol_type = other DNA
tcaatctacaccctatag

SEQ ID NO: 65021 - DNA, 18 bp, synthetic construct
  source 1..18: mol_type = other DNA
tcacaagagtccctctag

SEQ ID NO: 65022 - DNA, 18 bp, synthetic construct
  source 1..18: mol_type = other DNA
tcacacctctcactgttg

SEQ ID NO: 65023 - DNA, 18 bp, synthetic construct
  source 1..18: mol_type = other DNA
tcacacgacacgttatag

SEQ ID NO: 65024 - DNA, 18 bp, synthetic construct
  source 1..18: mol_type = other DNA
tcacacgactatctctag

SEQ ID NO: 65025 - DNA, 18 bp, synthetic construct
  source 1..18: mol_type = other DNA
tcacacgactctcaaaag

SEQ ID NO: 65026 - DNA, 18 bp, synthetic construct
  source 1..18: mol_type = other DNA
tcacaggcctctctacag

SEQ ID NO: 65027 - DNA, 18 bp, synthetic construct
  source 1..18: mol_type = other DNA
tcacccgtcccactagag

SEQ ID NO: 65028 - DNA, 18 bp, synthetic construct
  source 1..18: mol_type = other DNA
tcaccctactaattatag

SEQ ID NO: 65029 - DNA, 18 bp, synthetic construct
  source 1..18: mol_type = other DNA
tcacgtatctctctatag

SEQ ID NO: 65030 - DNA, 18 bp, synthetic construct
  source 1..18: mol_type = other DNA
tcagacgacttactcatg

SEQ ID NO: 65031 - DNA, 18 bp, synthetic construct
  source 1..18: mol_type = other DNA
tcagaggtctatctattg

SEQ ID NO: 65032 - DNA, 18 bp, synthetic construct
  source 1..18: mol_type = other DNA
tcataacacgcagtatag

SEQ ID NO: 65033 - DNA, 18 bp, synthetic construct
  source 1..18: mol_type = other DNA
tcataagacgctcttttg

SEQ ID NO: 65034 - DNA, 18 bp, synthetic construct
  source 1..18: mol_type = other DNA
tcataagactcagattag

SEQ ID NO: 65035 - DNA, 18 bp, synthetic construct
  source 1..18: mol_type = other DNA
tcataagactctataaag

SEQ ID NO: 65036 - DNA, 18 bp, synthetic construct
  source 1..18: mol_type = other DNA
tcatacaacacataatag

SEQ ID NO: 65037 - DNA, 18 bp, synthetic construct
  source 1..18: mol_type = other DNA
tcatacaagacactttag

SEQ ID NO: 65038 - DNA, 18 bp, synthetic construct
  source 1..18: mol_type = other DNA
tcatacaccgtactatag

SEQ ID NO: 65039 - DNA, 18 bp, synthetic construct
  source 1..18: mol_type = other DNA
tcatacccgacactttag

SEQ ID NO: 65040 - DNA, 18 bp, synthetic construct
  source 1..18: mol_type = other DNA
tcatacctctctctacag

SEQ ID NO: 65041 - DNA, 18 bp, synthetic construct
  source 1..18: mol_type = other DNA
tcatacgacgaacaacag

SEQ ID NO: 65042 - DNA, 18 bp, synthetic construct
  source 1..18: mol_type = other DNA
tcatacgaggctctaatg

SEQ ID NO: 65043 - DNA, 18 bp, synthetic construct
  source 1..18: mol_type = other DNA
tcatacgataccatacag

SEQ ID NO: 65044 - DNA, 18 bp, synthetic construct
  source 1..18: mol_type = other DNA
tcatacgattcacagaag

SEQ ID NO: 65045 - DNA, 18 bp, synthetic construct
  source 1..18: mol_type = other DNA
tcatacgtatcactgtcg

SEQ ID NO: 65046 - DNA, 18 bp, synthetic construct
  source 1..18: mol_type = other DNA
tcatacgtcccaatatcg

SEQ ID NO: 65047 - DNA, 18 bp, synthetic construct
  source 1..18: mol_type = other DNA
tcatacgtctcaccaatg

SEQ ID NO: 65048 - DNA, 18 bp, synthetic construct
  source 1..18: mol_type = other DNA
tcatacgtctcagaatcg

SEQ ID NO: 65049 - DNA, 18 bp, synthetic construct
  source 1..18: mol_type = other DNA
tcatacgtctcgcttacg

SEQ ID NO: 65050 - DNA, 18 bp, synthetic construct
  source 1..18: mol_type = other DNA
tcatacgtctctatcaag

SEQ ID NO: 65051 - DNA, 18 bp, synthetic construct
  source 1..18: mol_type = other DNA
tcatacgtctctcttgag

SEQ ID NO: 65052 - DNA, 18 bp, synthetic construct
  source 1..18: mol_type = other DNA
tcatacgtgttactttag

SEQ ID NO: 65053 - DNA, 18 bp, synthetic construct
  source 1..18: mol_type = other DNA
tcatactacacacaatcg

SEQ ID NO: 65054 - DNA, 18 bp, synthetic construct
  source 1..18: mol_type = other DNA
tcatactacacacctaag

SEQ ID NO: 65055 - DNA, 18 bp, synthetic construct
  source 1..18: mol_type = other DNA
tcatactagtcagtagag

SEQ ID NO: 65056 - DNA, 18 bp, synthetic construct
  source 1..18: mol_type = other DNA
tcatactattctctttcg

SEQ ID NO: 65057 - DNA, 18 bp, synthetic construct
  source 1..18: mol_type = other DNA
tcatacttcacacaatag

SEQ ID NO: 65058 - DNA, 18 bp, synthetic construct
  source 1..18: mol_type = other DNA
tcataggattcgctaaag

SEQ ID NO: 65059 - DNA, 18 bp, synthetic construct
  source 1..18: mol_type = other DNA
tcatatctcacacgcttg

SEQ ID NO: 65060 - DNA, 18 bp, synthetic construct
  source 1..18: mol_type = other DNA
tcatatgaatttctctag

SEQ ID NO: 65061 - DNA, 18 bp, synthetic construct
  source 1..18: mol_type = other DNA
tcatatgactcacttacg

SEQ ID NO: 65062 - DNA, 18 bp, synthetic construct
  source 1..18: mol_type = other DNA
tcatattactaatgattg

SEQ ID NO: 65063 - DNA, 18 bp, synthetic construct
  source 1..18: mol_type = other DNA
tcatatttcttacttatg

SEQ ID NO: 65064 - DNA, 18 bp, synthetic construct
  source 1..18: mol_type = other DNA
tcatgagacacaccaagg

SEQ ID NO: 65065 - DNA, 18 bp, synthetic construct
  source 1..18: mol_type = other DNA
tcatgccacttacatgag

SEQ ID NO: 65066 - DNA, 18 bp, synthetic construct
  source 1..18: mol_type = other DNA
tcatgcgactgaccatcg

SEQ ID NO: 65067 - DNA, 18 bp, synthetic construct
  source 1..18: mol_type = other DNA
tcatgcgtcccgctacag

SEQ ID NO: 65068 - DNA, 18 bp, synthetic construct
  source 1..18: mol_type = other DNA
tcattcatcccactatag

SEQ ID NO: 65069 - DNA, 18 bp, synthetic construct
  source 1..18: mol_type = other DNA
tcattcgacactaattag

SEQ ID NO: 65070 - DNA, 18 bp, synthetic construct
  source 1..18: mol_type = other DNA
tcattcggcacaccaaag

SEQ ID NO: 65071 - DNA, 18 bp, synthetic construct
  source 1..18: mol_type = other DNA
tcattcggctccccttag

SEQ ID NO: 65072 - DNA, 18 bp, synthetic construct
  source 1..18: mol_type = other DNA
tcattcgtctcacaaaag

SEQ ID NO: 65073 - DNA, 18 bp, synthetic construct
  source 1..18: mol_type = other DNA
tcatttgaatcattatag

SEQ ID NO: 65074 - DNA, 18 bp, synthetic construct
  source 1..18: mol_type = other DNA
tccaaagacgcactatag

SEQ ID NO: 65075 - DNA, 18 bp, synthetic construct
  source 1..18: mol_type = other DNA
tccaacgtgtgacaatag

SEQ ID NO: 65076 - DNA, 18 bp, synthetic construct
  source 1..18: mol_type = other DNA
tcccacgacactctacag

SEQ ID NO: 65077 - DNA, 18 bp, synthetic construct
  source 1..18: mol_type = other DNA
tcctacgacacacactag

SEQ ID NO: 65078 - DNA, 18 bp, synthetic construct
  source 1..18: mol_type = other DNA
tcctacgatttactaaag

SEQ ID NO: 65079 - DNA, 18 bp, synthetic construct
  source 1..18: mol_type = other DNA
tcctactactctaaatag

SEQ ID NO: 65080 - DNA, 18 bp, synthetic construct
  source 1..18: mol_type = other DNA
tcctactactttctattg

SEQ ID NO: 65081 - DNA, 18 bp, synthetic construct
  source 1..18: mol_type = other DNA
tcctttatatcaatatag

SEQ ID NO: 65082 - DNA, 18 bp, synthetic construct
  source 1..18: mol_type = other DNA
tcgcatttctctttatag

SEQ ID NO: 65083 - DNA, 18 bp, synthetic construct
  source 1..18: mol_type = other DNA
tcgtaagattcacctcag

SEQ ID NO: 65084 - DNA, 18 bp, synthetic construct
  source 1..18: mol_type = other DNA
tcgtaatacttgctttag

SEQ ID NO: 65085 - DNA, 18 bp, synthetic construct
  source 1..18: mol_type = other DNA
tcgtatgtgtcaattaag

SEQ ID NO: 65086 - DNA, 18 bp, synthetic construct
  source 1..18: mol_type = other DNA
tcgtttgactcaaaactg

SEQ ID NO: 65087 - DNA, 18 bp, synthetic construct
  source 1..18: mol_type = other DNA
tctaacaactcatcatag

SEQ ID NO: 65088 - DNA, 18 bp, synthetic construct
  source 1..18: mol_type = other DNA
tctaacgacactctaatg

SEQ ID NO: 65089 - DNA, 18 bp, synthetic construct
  source 1..18: mol_type = other DNA
tctaacgactctttagag

SEQ ID NO: 65090 - DNA, 18 bp, synthetic construct
  source 1..18: mol_type = other DNA
tctaacgtctcaccatag

SEQ ID NO: 65091 - DNA, 18 bp, synthetic construct
  source 1..18: mol_type = other DNA
tctatggattgacttagg

SEQ ID NO: 65092 - DNA, 18 bp, synthetic construct
  source 1..18: mol_type = other DNA
tcttacaacttacgttag

SEQ ID NO: 65093 - DNA, 18 bp, synthetic construct
  source 1..18: mol_type = other DNA
tcttaccaatcactttag

SEQ ID NO: 65094 - DNA, 18 bp, synthetic construct
  source 1..18: mol_type = other DNA
tcttacgacaaactaaag

SEQ ID NO: 65095 - DNA, 18 bp, synthetic construct
  source 1..18: mol_type = other DNA
tcttacgactcaataagg

SEQ ID NO: 65096 - DNA, 18 bp, synthetic construct
  source 1..18: mol_type = other DNA
tcttacgattcagtctag

SEQ ID NO: 65097 - DNA, 18 bp, synthetic construct
  source 1..18: mol_type = other DNA
tcttacgtatgaatttcg

SEQ ID NO: 65098 - DNA, 18 bp, synthetic construct
  source 1..18: mol_type = other DNA
tcttacgtcttactaaag

SEQ ID NO: 65099 - DNA, 18 bp, synthetic construct
  source 1..18: mol_type = other DNA
tcttagggcccactatcg

SEQ ID NO: 65100 - DNA, 18 bp, synthetic construct
  source 1..18: mol_type = other DNA
tcttatgactttctttag

SEQ ID NO: 65101 - DNA, 18 bp, synthetic construct
  source 1..18: mol_type = other DNA
tcttccgactcagtaaag

SEQ ID NO: 65102 - DNA, 18 bp, synthetic construct
  source 1..18: mol_type = other DNA
tcttcctactcaatgttg

SEQ ID NO: 65103 - DNA, 18 bp, synthetic construct
  source 1..18: mol_type = other DNA
tctttcatctcattatag

SEQ ID NO: 65104 - DNA, 18 bp, synthetic construct
  source 1..18: mol_type = other DNA
tctttcgtctcaatatag

SEQ ID NO: 65105 - DNA, 18 bp, synthetic construct
  source 1..18: mol_type = other DNA
tgaaaaaactcactattg

SEQ ID NO: 65106 - DNA, 18 bp, synthetic construct
  source 1..18: mol_type = other DNA
tgaaaccactaacagtag

SEQ ID NO: 65107 - DNA, 18 bp, synthetic construct
  source 1..18: mol_type = other DNA
tgaaacgactcagcacag

SEQ ID NO: 65108 - DNA, 18 bp, synthetic construct
  source 1..18: mol_type = other DNA
tgaaaggagtaactatag

SEQ ID NO: 65109 - DNA, 18 bp, synthetic construct
  source 1..18: mol_type = other DNA
tgaaatggctttctatag

SEQ ID NO: 65110 - DNA, 18 bp, synthetic construct
  source 1..18: mol_type = other DNA
tgaaatttctcagtttgg

SEQ ID NO: 65111 - DNA, 18 bp, synthetic construct
  source 1..18: mol_type = other DNA
tgaaccgtcatactatag

SEQ ID NO: 65112 - DNA, 18 bp, synthetic construct
  source 1..18: mol_type = other DNA
tgaagcgttcctttatag

SEQ ID NO: 65113 - DNA, 18 bp, synthetic construct
  source 1..18: mol_type = other DNA
tgacaccactctctatcg

SEQ ID NO: 65114 - DNA, 18 bp, synthetic construct
  source 1..18: mol_type = other DNA
tgacactactcacagatg

SEQ ID NO: 65115 - DNA, 18 bp, synthetic construct
  source 1..18: mol_type = other DNA
tgacatgactaattatag

SEQ ID NO: 65116 - DNA, 18 bp, synthetic construct
  source 1..18: mol_type = other DNA
tgaggctattaactttag

SEQ ID NO: 65117 - DNA, 18 bp, synthetic construct
  source 1..18: mol_type = other DNA
tgagtcgtctctctatag

SEQ ID NO: 65118 - DNA, 18 bp, synthetic construct
  source 1..18: mol_type = other DNA
tgataagactaacactag

SEQ ID NO: 65119 - DNA, 18 bp, synthetic construct
  source 1..18: mol_type = other DNA
tgataagagtcaatattg

SEQ ID NO: 65120 - DNA, 18 bp, synthetic construct
  source 1..18: mol_type = other DNA
tgataagattgactaatg

SEQ ID NO: 65121 - DNA, 18 bp, synthetic construct
  source 1..18: mol_type = other DNA
tgatacaacttaaaatag

SEQ ID NO: 65122 - DNA, 18 bp, synthetic construct
  source 1..18: mol_type = other DNA
tgatacatctctcttttg

SEQ ID NO: 65123 - DNA, 18 bp, synthetic construct
  source 1..18: mol_type = other DNA
tgataccactaagtatcg

SEQ ID NO: 65124 - DNA, 18 bp, synthetic construct
  source 1..18: mol_type = other DNA
tgataccattcacttaag

SEQ ID NO: 65125 - DNA, 18 bp, synthetic construct
  source 1..18: mol_type = other DNA
tgatacgaatccatattg

SEQ ID NO: 65126 - DNA, 18 bp, synthetic construct
  source 1..18: mol_type = other DNA
tgatacgactctagaaag

SEQ ID NO: 65127 - DNA, 18 bp, synthetic construct
  source 1..18: mol_type = other DNA
tgatacgactctcagaag

SEQ ID NO: 65128 - DNA, 18 bp, synthetic construct
  source 1..18: mol_type = other DNA
tgatacgacttttgtatg

SEQ ID NO: 65129 - DNA, 18 bp, synthetic construct
  source 1..18: mol_type = other DNA
tgatacgagactctcttg

SEQ ID NO: 65130 - DNA, 18 bp, synthetic construct
  source 1..18: mol_type = other DNA
tgatacgatacactaacg

SEQ ID NO: 65131 - DNA, 18 bp, synthetic construct
  source 1..18: mol_type = other DNA
tgatacgatacactacgg

SEQ ID NO: 65132 - DNA, 18 bp, synthetic construct
  source 1..18: mol_type = other DNA
tgatacgatttccaatag

SEQ ID NO: 65133 - DNA, 18 bp, synthetic construct
  source 1..18: mol_type = other DNA
tgatacgccaaactaaag

SEQ ID NO: 65134 - DNA, 18 bp, synthetic construct
  source 1..18: mol_type = other DNA
tgatacgtcacactctgg

SEQ ID NO: 65135 - DNA, 18 bp, synthetic construct
  source 1..18: mol_type = other DNA
tgatacgtttcactggtg

SEQ ID NO: 65136 - DNA, 18 bp, synthetic construct
  source 1..18: mol_type = other DNA
tgatactactaacattag

SEQ ID NO: 65137 - DNA, 18 bp, synthetic construct
  source 1..18: mol_type = other DNA
tgatagcactcaatttag

SEQ ID NO: 65138 - DNA, 18 bp, synthetic construct
  source 1..18: mol_type = other DNA
tgataggaccctatactg

SEQ ID NO: 65139 - DNA, 18 bp, synthetic construct
  source 1..18: mol_type = other DNA
tgataggtctctcgatag

SEQ ID NO: 65140 - DNA, 18 bp, synthetic construct
  source 1..18: mol_type = other DNA
tgatatgacttactactg

SEQ ID NO: 65141 - DNA, 18 bp, synthetic construct
  source 1..18: mol_type = other DNA
tgatatgtcttgcaatag

SEQ ID NO: 65142 - DNA, 18 bp, synthetic construct
  source 1..18: mol_type = other DNA
tgatccgactggttatag

SEQ ID NO: 65143 - DNA, 18 bp, synthetic construct
  source 1..18: mol_type = other DNA
tgatccggcttattatag

SEQ ID NO: 65144 - DNA, 18 bp, synthetic construct
  source 1..18: mol_type = other DNA
tgatctgtttcactatag

SEQ ID NO: 65145 - DNA, 18 bp, synthetic construct
  source 1..18: mol_type = other DNA
tgatgagacacactatcg

SEQ ID NO: 65146 - DNA, 18 bp, synthetic construct
  source 1..18: mol_type = other DNA
tgatgctacttaatattg

SEQ ID NO: 65147 - DNA, 18 bp, synthetic construct
  source 1..18: mol_type = other DNA
tgatgtaactcattatag

SEQ ID NO: 65148 - DNA, 18 bp, synthetic construct
  source 1..18: mol_type = other DNA
tgattagactcattatcg

SEQ ID NO: 65149 - DNA, 18 bp, synthetic construct
  source 1..18: mol_type = other DNA
tgattagtcttacaatag

SEQ ID NO: 65150 - DNA, 18 bp, synthetic construct
  source 1..18: mol_type = other DNA
tgattcctctcaaaacag

SEQ ID NO: 65151 - DNA, 18 bp, synthetic construct
  source 1..18: mol_type = other DNA
tgattctattcactattg

SEQ ID NO: 65152 - DNA, 18 bp, synthetic construct
  source 1..18: mol_type = other DNA
tgattctgctcattatgg

SEQ ID NO: 65153 - DNA, 18 bp, synthetic construct
  source 1..18: mol_type = other DNA
tgattggactcacaacag

SEQ ID NO: 65154 - DNA, 18 bp, synthetic construct
  source 1..18: mol_type = other DNA
tgcaactactcatgatag

SEQ ID NO: 65155 - DNA, 18 bp, synthetic construct
  source 1..18: mol_type = other DNA
tgcaaggacacaataaag

SEQ ID NO: 65156 - DNA, 18 bp, synthetic construct
  source 1..18: mol_type = other DNA
tgctaccacttacttttg

SEQ ID NO: 65157 - DNA, 18 bp, synthetic construct
  source 1..18: mol_type = other DNA
tgctatgtctctccatag

SEQ ID NO: 65158 - DNA, 18 bp, synthetic construct
  source 1..18: mol_type = other DNA
tgcttagacttacaaaag

SEQ ID NO: 65159 - DNA, 18 bp, synthetic construct
  source 1..18: mol_type = other DNA
tggtaccactcacttcag

SEQ ID NO: 65160 - DNA, 18 bp, synthetic construct
  source 1..18: mol_type = other DNA
tggtacgaaactctctag

SEQ ID NO: 65161 - DNA, 18 bp, synthetic construct
  source 1..18: mol_type = other DNA
tggtacgactcaccgttg

SEQ ID NO: 65162 - DNA, 18 bp, synthetic construct
  source 1..18: mol_type = other DNA
tggtacgctgcactatag

SEQ ID NO: 65163 - DNA, 18 bp, synthetic construct
  source 1..18: mol_type = other DNA
tggtaggtgtaactattg

SEQ ID NO: 65164 - DNA, 18 bp, synthetic construct
  source 1..18: mol_type = other DNA
tggtatgactccattttg

SEQ ID NO: 65165 - DNA, 18 bp, synthetic construct
  source 1..18: mol_type = other DNA
tggtcagactcattaatg

SEQ ID NO: 65166 - DNA, 18 bp, synthetic construct
  source 1..18: mol_type = other DNA
tggttcgattctttatag

SEQ ID NO: 65167 - DNA, 18 bp, synthetic construct
  source 1..18: mol_type = other DNA
tgtaacgacagacaattg

SEQ ID NO: 65168 - DNA, 18 bp, synthetic construct
  source 1..18: mol_type = other DNA
tgtaacgactaactacag

SEQ ID NO: 65169 - DNA, 18 bp, synthetic construct
  source 1..18: mol_type = other DNA
tgtaactacgcactattg

SEQ ID NO: 65170 - DNA, 18 bp, synthetic construct
  source 1..18: mol_type = other DNA
tgtatcaactcactaagg

SEQ ID NO: 65171 - DNA, 18 bp, synthetic construct
  source 1..18: mol_type = other DNA
tgtgataactcattttag

SEQ ID NO: 65172 - DNA, 18 bp, synthetic construct
  source 1..18: mol_type = other DNA
tgttaagtccctctaaag

SEQ ID NO: 65173 - DNA, 18 bp, synthetic construct
  source 1..18: mol_type = other DNA
tgttacaaatgactaaag

SEQ ID NO: 65174 - DNA, 18 bp, synthetic construct
  source 1..18: mol_type = other DNA
tgttacaactcactaagg

SEQ ID NO: 65175 - DNA, 18 bp, synthetic construct
  source 1..18: mol_type = other DNA
tgttacaattcgctagag

SEQ ID NO: 65176 - DNA, 18 bp, synthetic construct
  source 1..18: mol_type = other DNA
tgttacacctcgcttttg

SEQ ID NO: 65177 - DNA, 18 bp, synthetic construct
  source 1..18: mol_type = other DNA
tgttacctctcccaattg

SEQ ID NO: 65178 - DNA, 18 bp, synthetic construct
  source 1..18: mol_type = other DNA
tgttacgaatcactcagg

SEQ ID NO: 65179 - DNA, 18 bp, synthetic construct
  source 1..18: mol_type = other DNA
tgttacgacactgtatag

SEQ ID NO: 65180 - DNA, 18 bp, synthetic construct
  source 1..18: mol_type = other DNA
tgttacgacttccaaaag

SEQ ID NO: 65181 - DNA, 18 bp, synthetic construct
  source 1..18: mol_type = other DNA
tgttacgtctcaatattg

SEQ ID NO: 65182 - DNA, 18 bp, synthetic construct
  source 1..18: mol_type = other DNA
tgttagaactcattttgg

SEQ ID NO: 65183 - DNA, 18 bp, synthetic construct
  source 1..18: mol_type = other DNA
tgttaggtgtaactatag

SEQ ID NO: 65184 - DNA, 18 bp, synthetic construct
  source 1..18: mol_type = other DNA
tgttatgtaacactttag

SEQ ID NO: 65185 - DNA, 18 bp, synthetic construct
  source 1..18: mol_type = other DNA
tgttcagtctcgctgtag

SEQ ID NO: 65186 - DNA, 18 bp, synthetic construct
  source 1..18: mol_type = other DNA
tgtttagactcactattg

SEQ ID NO: 65187 - DNA, 18 bp, synthetic construct
  source 1..18: mol_type = other DNA
tgtttagataaactgtag

SEQ ID NO: 65188 - DNA, 18 bp, synthetic construct
  source 1..18: mol_type = other DNA
tgtttcgactcattgtag

SEQ ID NO: 65189 - DNA, 18 bp, synthetic construct
  source 1..18: mol_type = other DNA
tgtttctaatcactatag

SEQ ID NO: 65190 - DNA, 18 bp, synthetic construct
  source 1..18: mol_type = other DNA
tgttttgacacactaaag

SEQ ID NO: 65191 - DNA, 18 bp, synthetic construct
  source 1..18: mol_type = other DNA
ttaaaagattcattaaag

SEQ ID NO: 65192 - DNA, 18 bp, synthetic construct
  source 1..18: mol_type = other DNA
ttaaaatccacactattg

SEQ ID NO: 65193 - DNA, 18 bp, synthetic construct
  source 1..18: mol_type = other DNA
ttaaacaattcactacag

SEQ ID NO: 65194 - DNA, 18 bp, synthetic construct
  source 1..18: mol_type = other DNA
ttaaacaattcactttag

SEQ ID NO: 65195 - DNA, 18 bp, synthetic construct
  source 1..18: mol_type = other DNA
ttaaacatctttctatag

SEQ ID NO: 65196 - DNA, 18 bp, synthetic construct
  source 1..18: mol_type = other DNA
ttaaacgaaacactatgg

SEQ ID NO: 65197 - DNA, 18 bp, synthetic construct
  source 1..18: mol_type = other DNA
ttaaacgacacccttttg

SEQ ID NO: 65198 - DNA, 18 bp, synthetic construct
  source 1..18: mol_type = other DNA
ttaaacgactcgctttcg

SEQ ID NO: 65199 - DNA, 18 bp, synthetic construct
  source 1..18: mol_type = other DNA
ttaaacgactctcgaaag

SEQ ID NO: 65200 - DNA, 18 bp, synthetic construct
  source 1..18: mol_type = other DNA
ttaaacgacttacataag

SEQ ID NO: 65201 - DNA, 18 bp, synthetic construct
  source 1..18: mol_type = other DNA
ttaaacgattgtctatag

SEQ ID NO: 65202 - DNA, 18 bp, synthetic construct
  source 1..18: mol_type = other DNA
ttaaacggtactctacag

SEQ ID NO: 65203 - DNA, 18 bp, synthetic construct
  source 1..18: mol_type = other DNA
ttaaacgtctattttacg

SEQ ID NO: 65204 - DNA, 18 bp, synthetic construct
  source 1..18: mol_type = other DNA
ttaaacgtctcacgaatg

SEQ ID NO: 65205 - DNA, 18 bp, synthetic construct
  source 1..18: mol_type = other DNA
ttaaactacgatctaaag

SEQ ID NO: 65206 - DNA, 18 bp, synthetic construct
  source 1..18: mol_type = other DNA
ttaaacttatcactatcg

SEQ ID NO: 65207 - DNA, 18 bp, synthetic construct
  source 1..18: mol_type = other DNA
ttaaacttctctatatag

SEQ ID NO: 65208 - DNA, 18 bp, synthetic construct
  source 1..18: mol_type = other DNA
ttaaagttctcattgtag

SEQ ID NO: 65209 - DNA, 18 bp, synthetic construct
  source 1..18: mol_type = other DNA
ttaaatgcctcagactag

SEQ ID NO: 65210 - DNA, 18 bp, synthetic construct
  source 1..18: mol_type = other DNA
ttaacccactcactttag

SEQ ID NO: 65211 - DNA, 18 bp, synthetic construct
  source 1..18: mol_type = other DNA
ttaaccgacgcatgattg

SEQ ID NO: 65212 - DNA, 18 bp, synthetic construct
  source 1..18: mol_type = other DNA
ttaaccgcctcaaaatag

SEQ ID NO: 65213 - DNA, 18 bp, synthetic construct
  source 1..18: mol_type = other DNA
ttaagcgatatactatag

SEQ ID NO: 65214 - DNA, 18 bp, synthetic construct
  source 1..18: mol_type = other DNA
ttaatagacccactacag

SEQ ID NO: 65215 - DNA, 18 bp, synthetic construct
  source 1..18: mol_type = other DNA
ttaatcaaccatcgtttg

SEQ ID NO: 65216 - DNA, 18 bp, synthetic construct
  source 1..18: mol_type = other DNA
ttaatcgactcacaaaag

SEQ ID NO: 65217 - DNA, 18 bp, synthetic construct
  source 1..18: mol_type = other DNA
ttaatcgtctcactctag

SEQ ID NO: 65218 - DNA, 18 bp, synthetic construct
  source 1..18: mol_type = other DNA
ttaatcgtctctctttag

SEQ ID NO: 65219 - DNA, 18 bp, synthetic construct
  source 1..18: mol_type = other DNA
ttacacacctcactgtag

SEQ ID NO: 65220 - DNA, 18 bp, synthetic construct
  source 1..18: mol_type = other DNA
ttacaccactcagaatag

SEQ ID NO: 65221 - DNA, 18 bp, synthetic construct
  source 1..18: mol_type = other DNA
ttacacgactaacagtag

SEQ ID NO: 65222 - DNA, 18 bp, synthetic construct
  source 1..18: mol_type = other DNA
ttacacgactcccacatg

SEQ ID NO: 65223 - DNA, 18 bp, synthetic construct
  source 1..18: mol_type = other DNA
ttacacgtaacactacag

SEQ ID NO: 65224 - DNA, 18 bp, synthetic construct
  source 1..18: mol_type = other DNA
ttacactactcaatttag

SEQ ID NO: 65225 - DNA, 18 bp, synthetic construct
  source 1..18: mol_type = other DNA
ttacatgactcgatatgg

SEQ ID NO: 65226 - DNA, 18 bp, synthetic construct
  source 1..18: mol_type = other DNA
ttacatgactttccatag

SEQ ID NO: 65227 - DNA, 18 bp, synthetic construct
  source 1..18: mol_type = other DNA
ttaccttactcactaaag

SEQ ID NO: 65228 - DNA, 18 bp, synthetic construct
  source 1..18: mol_type = other DNA
ttactagactatttaaag

SEQ ID NO: 65229 - DNA, 18 bp, synthetic construct
  source 1..18: mol_type = other DNA
ttactcgactcacttttg

SEQ ID NO: 65230 - DNA, 18 bp, synthetic construct
  source 1..18: mol_type = other DNA
ttactcggatcaccacag

SEQ ID NO: 65231 - DNA, 18 bp, synthetic construct
  source 1..18: mol_type = other DNA
ttagacgacacacattag

SEQ ID NO: 65232 - DNA, 18 bp, synthetic construct
  source 1..18: mol_type = other DNA
ttagacggttctctttag

SEQ ID NO: 65233 - DNA, 18 bp, synthetic construct
  source 1..18: mol_type = other DNA
ttagattactcactaaag

SEQ ID NO: 65234 - DNA, 18 bp, synthetic construct
  source 1..18: mol_type = other DNA
ttagccgacacacattag

SEQ ID NO: 65235 - DNA, 18 bp, synthetic construct
  source 1..18: mol_type = other DNA
ttataaatcacactatag

SEQ ID NO: 65236 - DNA, 18 bp, synthetic construct
  source 1..18: mol_type = other DNA
ttataacatacactatag

SEQ ID NO: 65237 - DNA, 18 bp, synthetic construct
  source 1..18: mol_type = other DNA
ttataactctcacaatag

SEQ ID NO: 65238 - DNA, 18 bp, synthetic construct
  source 1..18: mol_type = other DNA
ttataagaattactgtag

SEQ ID NO: 65239 - DNA, 18 bp, synthetic construct
  source 1..18: mol_type = other DNA
ttataagacacgctaaag

SEQ ID NO: 65240 - DNA, 18 bp, synthetic construct
  source 1..18: mol_type = other DNA
ttataagactaattagtg

SEQ ID NO: 65241 - DNA, 18 bp, synthetic construct
  source 1..18: mol_type = other DNA
ttataagactgattattg

SEQ ID NO: 65242 - DNA, 18 bp, synthetic construct
  source 1..18: mol_type = other DNA
ttataagtccctgtatag

SEQ ID NO: 65243 - DNA, 18 bp, synthetic construct
  source 1..18: mol_type = other DNA
ttataataatctctaaag

SEQ ID NO: 65244 - DNA, 18 bp, synthetic construct
  source 1..18: mol_type = other DNA
ttataatacccactattg

SEQ ID NO: 65245 - DNA, 18 bp, synthetic construct
  source 1..18: mol_type = other DNA
ttataatactctctagcg

SEQ ID NO: 65246 - DNA, 18 bp, synthetic construct
  source 1..18: mol_type = other DNA
ttataatagtaaccattg

SEQ ID NO: 65247 - DNA, 18 bp, synthetic construct
  source 1..18: mol_type = other DNA
ttataattctctccaaag

SEQ ID NO: 65248 - DNA, 18 bp, synthetic construct
  source 1..18: mol_type = other DNA
ttatacaaatctcaattg

SEQ ID NO: 65249 - DNA, 18 bp, synthetic construct
  source 1..18: mol_type = other DNA
ttatacaacacattctag

SEQ ID NO: 65250 - DNA, 18 bp, synthetic construct
  source 1..18: mol_type = other DNA
ttatacaactaaccattg

SEQ ID NO: 65251 - DNA, 18 bp, synthetic construct
  source 1..18: mol_type = other DNA
ttatacaactaagtctag

SEQ ID NO: 65252 - DNA, 18 bp, synthetic construct
  source 1..18: mol_type = other DNA
ttatacaactcatcaaag

SEQ ID NO: 65253 - DNA, 18 bp, synthetic construct
  source 1..18: mol_type = other DNA
ttatacacctccgtcaag

SEQ ID NO: 65254 - DNA, 18 bp, synthetic construct
  source 1..18: mol_type = other DNA
ttatacatacctctctag

SEQ ID NO: 65255 - DNA, 18 bp, synthetic construct
  source 1..18: mol_type = other DNA
ttatacatatcaattttg

SEQ ID NO: 65256 - DNA, 18 bp, synthetic construct
  source 1..18: mol_type = other DNA
ttatacatcaaccgaaag

SEQ ID NO: 65257 - DNA, 18 bp, synthetic construct
  source 1..18: mol_type = other DNA
ttatacatctcactaccg

SEQ ID NO: 65258 - DNA, 18 bp, synthetic construct
  source 1..18: mol_type = other DNA
ttatacatgccactatag

SEQ ID NO: 65259 - DNA, 18 bp, synthetic construct
  source 1..18: mol_type = other DNA
ttatacatttctctgtag

SEQ ID NO: 65260 - DNA, 18 bp, synthetic construct
  source 1..18: mol_type = other DNA
ttatacattttattaaag

SEQ ID NO: 65261 - DNA, 18 bp, synthetic construct
  source 1..18: mol_type = other DNA
ttataccaatcactaacg

SEQ ID NO: 65262 - DNA, 18 bp, synthetic construct
  source 1..18: mol_type = other DNA
ttataccaatgactaaag

SEQ ID NO: 65263 - DNA, 18 bp, synthetic construct
  source 1..18: mol_type = other DNA
ttataccactcaattaag

SEQ ID NO: 65264 - DNA, 18 bp, synthetic construct
  source 1..18: mol_type = other DNA
ttataccatatatgaaag

SEQ ID NO: 65265 - DNA, 18 bp, synthetic construct
  source 1..18: mol_type = other DNA
ttatacgaaaaactatgg

SEQ ID NO: 65266 - DNA, 18 bp, synthetic construct
  source 1..18: mol_type = other DNA
ttatacgaaatactaaag

SEQ ID NO: 65267 - DNA, 18 bp, synthetic construct
  source 1..18: mol_type = other DNA
ttatacgaaccacttaag

SEQ ID NO: 65268 - DNA, 18 bp, synthetic construct
  source 1..18: mol_type = other DNA
ttatacgaatctctcaag

SEQ ID NO: 65269 - DNA, 18 bp, synthetic construct
  source 1..18: mol_type = other DNA
ttatacgaattaatgtag

SEQ ID NO: 65270 - DNA, 18 bp, synthetic construct
  source 1..18: mol_type = other DNA
ttatacgacaccctaggg

SEQ ID NO: 65271 - DNA, 18 bp, synthetic construct
  source 1..18: mol_type = other DNA
ttatacgacactaaatag

SEQ ID NO: 65272 - DNA, 18 bp, synthetic construct
  source 1..18: mol_type = other DNA
ttatacgacagattattg

SEQ ID NO: 65273 - DNA, 18 bp, synthetic construct
  source 1..18: mol_type = other DNA
ttatacgacagtccttcg

SEQ ID NO: 65274 - DNA, 18 bp, synthetic construct
  source 1..18: mol_type = other DNA
ttatacgacattctctag

SEQ ID NO: 65275 - DNA, 18 bp, synthetic construct
  source 1..18: mol_type = other DNA
ttatacgacctaccgtag

SEQ ID NO: 65276 - DNA, 18 bp, synthetic construct
  source 1..18: mol_type = other DNA
ttatacgacgatgttcag

SEQ ID NO: 65277 - DNA, 18 bp, synthetic construct
  source 1..18: mol_type = other DNA
ttatacgactatatattg

SEQ ID NO: 65278 - DNA, 18 bp, synthetic construct
  source 1..18: mol_type = other DNA
ttatacgactatccctag

SEQ ID NO: 65279 - DNA, 18 bp, synthetic construct
  source 1..18: mol_type = other DNA
ttatacgactatctcaag

SEQ ID NO: 65280 - DNA, 18 bp, synthetic construct
  source 1..18: mol_type = other DNA
ttatacgacttatattag

SEQ ID NO: 65281 - DNA, 18 bp, synthetic construct
  source 1..18: mol_type = other DNA
ttatacgactttcaaaag

SEQ ID NO: 65282 - DNA, 18 bp, synthetic construct
  source 1..18: mol_type = other DNA
ttatacgagactgtatag

SEQ ID NO: 65283 - DNA, 18 bp, synthetic construct
  source 1..18: mol_type = other DNA
ttatacgatactctttag

SEQ ID NO: 65284 - DNA, 18 bp, synthetic construct
  source 1..18: mol_type = other DNA
ttatacgattccgcatag

SEQ ID NO: 65285 - DNA, 18 bp, synthetic construct
  source 1..18: mol_type = other DNA
ttatacgattgtccatcg

SEQ ID NO: 65286 - DNA, 18 bp, synthetic construct
  source 1..18: mol_type = other DNA
ttatacgcattgataaag

SEQ ID NO: 65287 - DNA, 18 bp, synthetic construct
  source 1..18: mol_type = other DNA
ttatacgctgcattatag

SEQ ID NO: 65288 - DNA, 18 bp, synthetic construct
  source 1..18: mol_type = other DNA
ttatacggcgccctacag

SEQ ID NO: 65289 - DNA, 18 bp, synthetic construct
  source 1..18: mol_type = other DNA
ttatacggctagccaaag

SEQ ID NO: 65290 - DNA, 18 bp, synthetic construct
  source 1..18: mol_type = other DNA
ttatacggctcacctaag

SEQ ID NO: 65291 - DNA, 18 bp, synthetic construct
  source 1..18: mol_type = other DNA
ttatacggctctccttag

SEQ ID NO: 65292 - DNA, 18 bp, synthetic construct
  source 1..18: mol_type = other DNA
ttatacgggacacaatag

SEQ ID NO: 65293 - DNA, 18 bp, synthetic construct
  source 1..18: mol_type = other DNA
ttatacgtatcataacag

SEQ ID NO: 65294 - DNA, 18 bp, synthetic construct
  source 1..18: mol_type = other DNA
ttatacgtcacactttgg

SEQ ID NO: 65295 - DNA, 18 bp, synthetic construct
  source 1..18: mol_type = other DNA
ttatacgtcacattaacg

SEQ ID NO: 65296 - DNA, 18 bp, synthetic construct
  source 1..18: mol_type = other DNA
ttatacgtctcatttctg

SEQ ID NO: 65297 - DNA, 18 bp, synthetic construct
  source 1..18: mol_type = other DNA
ttatacgtcttagtctag

SEQ ID NO: 65298 - DNA, 18 bp, synthetic construct
  source 1..18: mol_type = other DNA
ttatacgtttcgttatag

SEQ ID NO: 65299 - DNA, 18 bp, synthetic construct
  source 1..18: mol_type = other DNA
ttatactaatcgatattg

SEQ ID NO: 65300 - DNA, 18 bp, synthetic construct
  source 1..18: mol_type = other DNA
ttatactactctccctag

SEQ ID NO: 65301 - DNA, 18 bp, synthetic construct
  source 1..18: mol_type = other DNA
ttatactatagtcttttg

SEQ ID NO: 65302 - DNA, 18 bp, synthetic construct
  source 1..18: mol_type = other DNA
ttatactgcttactttag

SEQ ID NO: 65303 - DNA, 18 bp, synthetic construct
  source 1..18: mol_type = other DNA
ttatactttactctcaag

SEQ ID NO: 65304 - DNA, 18 bp, synthetic construct
  source 1..18: mol_type = other DNA
ttatacttttcattattg

SEQ ID NO: 65305 - DNA, 18 bp, synthetic construct
  source 1..18: mol_type = other DNA
ttatactttttattatag

SEQ ID NO: 65306 - DNA, 18 bp, synthetic construct
  source 1..18: mol_type = other DNA
ttatagcacttactattg

SEQ ID NO: 65307 - DNA, 18 bp, synthetic construct
  source 1..18: mol_type = other DNA
ttataggacccacgaaag

SEQ ID NO: 65308 - DNA, 18 bp, synthetic construct
  source 1..18: mol_type = other DNA
ttataggactagctaaag

SEQ ID NO: 65309 - DNA, 18 bp, synthetic construct
  source 1..18: mol_type = other DNA
ttataggtctcaccaaag

SEQ ID NO: 65310 - DNA, 18 bp, synthetic construct
  source 1..18: mol_type = other DNA
ttataggtctctctaaag

SEQ ID NO: 65311 - DNA, 18 bp, synthetic construct
  source 1..18: mol_type = other DNA
ttataggtctctctttag

SEQ ID NO: 65312 - DNA, 18 bp, synthetic construct
  source 1..18: mol_type = other DNA
ttatataaatcagtatag

SEQ ID NO: 65313 - DNA, 18 bp, synthetic construct
  source 1..18: mol_type = other DNA
ttatataactcactctcg

SEQ ID NO: 65314 - DNA, 18 bp, synthetic construct
  source 1..18: mol_type = other DNA
ttatatcactccctcttg

SEQ ID NO: 65315 - DNA, 18 bp, synthetic construct
  source 1..18: mol_type = other DNA
ttatatgaatcacctaag

SEQ ID NO: 65316 - DNA, 18 bp, synthetic construct
  source 1..18: mol_type = other DNA
ttatatgacacacttctg

SEQ ID NO: 65317 - DNA, 18 bp, synthetic construct
  source 1..18: mol_type = other DNA
ttatatgacccaccctag

SEQ ID NO: 65318 - DNA, 18 bp, synthetic construct
  source 1..18: mol_type = other DNA
ttatatgatttactcttg

SEQ ID NO: 65319 - DNA, 18 bp, synthetic construct
  source 1..18: mol_type = other DNA
ttatatgcctctttattg

SEQ ID NO: 65320 - DNA, 18 bp, synthetic construct
  source 1..18: mol_type = other DNA
ttatatggctcaatttag

SEQ ID NO: 65321 - DNA, 18 bp, synthetic construct
  source 1..18: mol_type = other DNA
ttatattacactcagttg

SEQ ID NO: 65322 - DNA, 18 bp, synthetic construct
  source 1..18: mol_type = other DNA
ttatattacactctttag

SEQ ID NO: 65323 - DNA, 18 bp, synthetic construct
  source 1..18: mol_type = other DNA
ttatcagacaccctatag

SEQ ID NO: 65324 - DNA, 18 bp, synthetic construct
  source 1..18: mol_type = other DNA
ttatccacctcacaatag

SEQ ID NO: 65325 - DNA, 18 bp, synthetic construct
  source 1..18: mol_type = other DNA
ttatccgaatctatttag

SEQ ID NO: 65326 - DNA, 18 bp, synthetic construct
  source 1..18: mol_type = other DNA
ttatccgcctcactaacg

SEQ ID NO: 65327 - DNA, 18 bp, synthetic construct
  source 1..18: mol_type = other DNA
ttatctcactcactattg

SEQ ID NO: 65328 - DNA, 18 bp, synthetic construct
  source 1..18: mol_type = other DNA
ttatcttaccttctaatg

SEQ ID NO: 65329 - DNA, 18 bp, synthetic construct
  source 1..18: mol_type = other DNA
ttatgaaccatacatcag

SEQ ID NO: 65330 - DNA, 18 bp, synthetic construct
  source 1..18: mol_type = other DNA
ttatgcgagtctaccttg

SEQ ID NO: 65331 - DNA, 18 bp, synthetic construct
  source 1..18: mol_type = other DNA
ttatgcgatttatttaag

SEQ ID NO: 65332 - DNA, 18 bp, synthetic construct
  source 1..18: mol_type = other DNA
ttatgcgcctccgtatag

SEQ ID NO: 65333 - DNA, 18 bp, synthetic construct
  source 1..18: mol_type = other DNA
ttatgcgtctcgctggtg

SEQ ID NO: 65334 - DNA, 18 bp, synthetic construct
  source 1..18: mol_type = other DNA
ttatgctactcgcttttg

SEQ ID NO: 65335 - DNA, 18 bp, synthetic construct
  source 1..18: mol_type = other DNA
ttatgtgtctcaaaaaag

SEQ ID NO: 65336 - DNA, 18 bp, synthetic construct
  source 1..18: mol_type = other DNA
ttattagattcactgtag

SEQ ID NO: 65337 - DNA, 18 bp, synthetic construct
  source 1..18: mol_type = other DNA
ttattcaccactccagcg

SEQ ID NO: 65338 - DNA, 18 bp, synthetic construct
  source 1..18: mol_type = other DNA
ttattccacacactagtg

SEQ ID NO: 65339 - DNA, 18 bp, synthetic construct
  source 1..18: mol_type = other DNA
ttattcgacacaccattg

SEQ ID NO: 65340 - DNA, 18 bp, synthetic construct
  source 1..18: mol_type = other DNA
ttattcgaccaactacag

SEQ ID NO: 65341 - DNA, 18 bp, synthetic construct
  source 1..18: mol_type = other DNA
ttattcgacgctcttttg

SEQ ID NO: 65342 - DNA, 18 bp, synthetic construct
  source 1..18: mol_type = other DNA
ttattcgactaactgagg

SEQ ID NO: 65343 - DNA, 18 bp, synthetic construct
  source 1..18: mol_type = other DNA
ttattcgactcagtactg

SEQ ID NO: 65344 - DNA, 18 bp, synthetic construct
  source 1..18: mol_type = other DNA
ttattcgacttgctactg

SEQ ID NO: 65345 - DNA, 18 bp, synthetic construct
  source 1..18: mol_type = other DNA
ttattcgatacgcaaaag

SEQ ID NO: 65346 - DNA, 18 bp, synthetic construct
  source 1..18: mol_type = other DNA
ttattcgattcgctatcg

SEQ ID NO: 65347 - DNA, 18 bp, synthetic construct
  source 1..18: mol_type = other DNA
ttattcggttcactttag

SEQ ID NO: 65348 - DNA, 18 bp, synthetic construct
  source 1..18: mol_type = other DNA
ttattcgtatcaatatag

SEQ ID NO: 65349 - DNA, 18 bp, synthetic construct
  source 1..18: mol_type = other DNA
ttattcgtcccacaatta

SEQ ID NO: 65350 - DNA, 18 bp, synthetic construct
  source 1..18: mol_type = other DNA
ttattcgtcttacaatcg

SEQ ID NO: 65351 - DNA, 18 bp, synthetic construct
  source 1..18: mol_type = other DNA
ttattcgtcttacttttg

SEQ ID NO: 65352 - DNA, 18 bp, synthetic construct
  source 1..18: mol_type = other DNA
ttattctactaaatttag

SEQ ID NO: 65353 - DNA, 18 bp, synthetic construct
  source 1..18: mol_type = other DNA
ttattctactcaataaag

SEQ ID NO: 65354 - DNA, 18 bp, synthetic construct
  source 1..18: mol_type = other DNA
ttattcttctcactacag

SEQ ID NO: 65355 - DNA, 18 bp, synthetic construct
  source 1..18: mol_type = other DNA
ttattggaatcacaatag

SEQ ID NO: 65356 - DNA, 18 bp, synthetic construct
  source 1..18: mol_type = other DNA
ttattggattcactgtag

SEQ ID NO: 65357 - DNA, 18 bp, synthetic construct
  source 1..18: mol_type = other DNA
ttatttaactcactaaag

SEQ ID NO: 65358 - DNA, 18 bp, synthetic construct
  source 1..18: mol_type = other DNA
ttatttgacacactaatg

SEQ ID NO: 65359 - DNA, 18 bp, synthetic construct
  source 1..18: mol_type = other DNA
ttatttgatacacattag

SEQ ID NO: 65360 - DNA, 18 bp, synthetic construct
  source 1..18: mol_type = other DNA
ttatttgcctcacttttg

SEQ ID NO: 65361 - DNA, 18 bp, synthetic construct
  source 1..18: mol_type = other DNA
ttattttcctcactatag

SEQ ID NO: 65362 - DNA, 18 bp, synthetic construct
  source 1..18: mol_type = other DNA
ttcaaagaatcacgaaag

SEQ ID NO: 65363 - DNA, 18 bp, synthetic construct
  source 1..18: mol_type = other DNA
ttcaaattctaactgtcg

SEQ ID NO: 65364 - DNA, 18 bp, synthetic construct
  source 1..18: mol_type = other DNA
ttcaacgaaccactattg

SEQ ID NO: 65365 - DNA, 18 bp, synthetic construct
  source 1..18: mol_type = other DNA
ttcaacgacatagtatag

SEQ ID NO: 65366 - DNA, 18 bp, synthetic construct
  source 1..18: mol_type = other DNA
ttcaacgtttgtttttag

SEQ ID NO: 65367 - DNA, 18 bp, synthetic construct
  source 1..18: mol_type = other DNA
ttcaactaatctctaaag

SEQ ID NO: 65368 - DNA, 18 bp, synthetic construct
  source 1..18: mol_type = other DNA
ttccacgactaactacag

SEQ ID NO: 65369 - DNA, 18 bp, synthetic construct
  source 1..18: mol_type = other DNA
ttccacgactccttatag

SEQ ID NO: 65370 - DNA, 18 bp, synthetic construct
  source 1..18: mol_type = other DNA
ttccacgactctctcatg

SEQ ID NO: 65371 - DNA, 18 bp, synthetic construct
  source 1..18: mol_type = other DNA
ttccactactctctatag

SEQ ID NO: 65372 - DNA, 18 bp, synthetic construct
  source 1..18: mol_type = other DNA
ttccacttatcacgaaag

SEQ ID NO: 65373 - DNA, 18 bp, synthetic construct
  source 1..18: mol_type = other DNA
ttccatgtcactatatag

SEQ ID NO: 65374 - DNA, 18 bp, synthetic construct
  source 1..18: mol_type = other DNA
ttcgaagactctcgttcg

SEQ ID NO: 65375 - DNA, 18 bp, synthetic construct
  source 1..18: mol_type = other DNA
ttctacaaaacattatag

SEQ ID NO: 65376 - DNA, 18 bp, synthetic construct
  source 1..18: mol_type = other DNA
ttctacgaatttagattg

SEQ ID NO: 65377 - DNA, 18 bp, synthetic construct
  source 1..18: mol_type = other DNA
ttctacgacacattaaag

SEQ ID NO: 65378 - DNA, 18 bp, synthetic construct
  source 1..18: mol_type = other DNA
ttctacgacagaccatag

SEQ ID NO: 65379 - DNA, 18 bp, synthetic construct
  source 1..18: mol_type = other DNA
ttctacgcatctcgatgg

SEQ ID NO: 65380 - DNA, 18 bp, synthetic construct
  source 1..18: mol_type = other DNA
ttctacgtctaacattag

SEQ ID NO: 65381 - DNA, 18 bp, synthetic construct
  source 1..18: mol_type = other DNA
ttctacgtctctatttag

SEQ ID NO: 65382 - DNA, 18 bp, synthetic construct
  source 1..18: mol_type = other DNA
ttctatgtctaactttcg

SEQ ID NO: 65383 - DNA, 18 bp, synthetic construct
  source 1..18: mol_type = other DNA
ttctccgaatcagtatgg

SEQ ID NO: 65384 - DNA, 18 bp, synthetic construct
  source 1..18: mol_type = other DNA
ttgaacaacacaatatgg

SEQ ID NO: 65385 - DNA, 18 bp, synthetic construct
  source 1..18: mol_type = other DNA
ttgaacaactcgctattg

SEQ ID NO: 65386 - DNA, 18 bp, synthetic construct
  source 1..18: mol_type = other DNA
ttgaaccacactcaatgg

SEQ ID NO: 65387 - DNA, 18 bp, synthetic construct
  source 1..18: mol_type = other DNA
ttgcacgacacacattag

SEQ ID NO: 65388 - DNA, 18 bp, synthetic construct
  source 1..18: mol_type = other DNA
ttggagcacactctatag

SEQ ID NO: 65389 - DNA, 18 bp, synthetic construct
  source 1..18: mol_type = other DNA
ttgtacaacccacaatag

SEQ ID NO: 65390 - DNA, 18 bp, synthetic construct
  source 1..18: mol_type = other DNA
ttgtacgagtaaatatag

SEQ ID NO: 65391 - DNA, 18 bp, synthetic construct
  source 1..18: mol_type = other DNA
ttgtacgtctaaccatag

SEQ ID NO: 65392 - DNA, 18 bp, synthetic construct
  source 1..18: mol_type = other DNA
ttgtactacttattatag

SEQ ID NO: 65393 - DNA, 18 bp, synthetic construct
  source 1..18: mol_type = other DNA
ttgtagcccgtactatag

SEQ ID NO: 65394 - DNA, 18 bp, synthetic construct
  source 1..18: mol_type = other DNA
ttgtatgacacactttag

SEQ ID NO: 65395 - DNA, 18 bp, synthetic construct
  source 1..18: mol_type = other DNA
ttgtatgactcaatatcg

SEQ ID NO: 65396 - DNA, 18 bp, synthetic construct
  source 1..18: mol_type = other DNA
ttgtatgactcactttgg

SEQ ID NO: 65397 - DNA, 18 bp, synthetic construct
  source 1..18: mol_type = other DNA
ttgtatgtctctctttag

SEQ ID NO: 65398 - DNA, 18 bp, synthetic construct
  source 1..18: mol_type = other DNA
ttgtattacttactatag

SEQ ID NO: 65399 - DNA, 18 bp, synthetic construct
  source 1..18: mol_type = other DNA
ttgtctgactctctacag

SEQ ID NO: 65400 - DNA, 18 bp, synthetic construct
  source 1..18: mol_type = other DNA
ttgtgcgacttagaatag

SEQ ID NO: 65401 - DNA, 18 bp, synthetic construct
  source 1..18: mol_type = other DNA
ttgtgcgtgtctctattg

SEQ ID NO: 65402 - DNA, 18 bp, synthetic construct
  source 1..18: mol_type = other DNA
ttgtgcttcacactatag

SEQ ID NO: 65403 - DNA, 18 bp, synthetic construct
  source 1..18: mol_type = other DNA
ttgttcgaatcagtatag

SEQ ID NO: 65404 - DNA, 18 bp, synthetic construct
  source 1..18: mol_type = other DNA
ttgttcgacaaaccattg

SEQ ID NO: 65405 - DNA, 18 bp, synthetic construct
  source 1..18: mol_type = other DNA
tttaaacacgcactattg

SEQ ID NO: 65406 - DNA, 18 bp, synthetic construct
  source 1..18: mol_type = other DNA
tttaaagacttactatag

SEQ ID NO: 65407 - DNA, 18 bp, synthetic construct
  source 1..18: mol_type = other DNA
tttaacaacatactattg

SEQ ID NO: 65408 - DNA, 18 bp, synthetic construct
  source 1..18: mol_type = other DNA
tttaaccaatcacaatag

SEQ ID NO: 65409 - DNA, 18 bp, synthetic construct
  source 1..18: mol_type = other DNA
tttaacgacacaccatag

SEQ ID NO: 65410 - DNA, 18 bp, synthetic construct
  source 1..18: mol_type = other DNA
tttaacgactaacgttag

SEQ ID NO: 65411 - DNA, 18 bp, synthetic construct
  source 1..18: mol_type = other DNA
tttaacgagttgctatgg

SEQ ID NO: 65412 - DNA, 18 bp, synthetic construct
  source 1..18: mol_type = other DNA
tttaacgcctcacttttg

SEQ ID NO: 65413 - DNA, 18 bp, synthetic construct
  source 1..18: mol_type = other DNA
tttaacgtctctcaacag

SEQ ID NO: 65414 - DNA, 18 bp, synthetic construct
  source 1..18: mol_type = other DNA
tttaacgtctgtctattg

SEQ ID NO: 65415 - DNA, 18 bp, synthetic construct
  source 1..18: mol_type = other DNA
tttaactagtcactatag

SEQ ID NO: 65416 - DNA, 18 bp, synthetic construct
  source 1..18: mol_type = other DNA
tttagcgtctcactaaag

SEQ ID NO: 65417 - DNA, 18 bp, synthetic construct
  source 1..18: mol_type = other DNA
tttatcgactcactttag

SEQ ID NO: 65418 - DNA, 18 bp, synthetic construct
  source 1..18: mol_type = other DNA
tttatcgattctcaagag

SEQ ID NO: 65419 - DNA, 18 bp, synthetic construct
  source 1..18: mol_type = other DNA
tttatcgattctctaaag

SEQ ID NO: 65420 - DNA, 18 bp, synthetic construct
  source 1..18: mol_type = other DNA
tttcacaattcccaatag

SEQ ID NO: 65421 - DNA, 18 bp, synthetic construct
  source 1..18: mol_type = other DNA
tttcacgactaaccatag

SEQ ID NO: 65422 - DNA, 18 bp, synthetic construct
  source 1..18: mol_type = other DNA
tttcacgactgactaaag

SEQ ID NO: 65423 - DNA, 18 bp, synthetic construct
  source 1..18: mol_type = other DNA
tttctagactaattatag

SEQ ID NO: 65424 - DNA, 18 bp, synthetic construct
  source 1..18: mol_type = other DNA
tttctcgaatccgtttcg

SEQ ID NO: 65425 - DNA, 18 bp, synthetic construct
  source 1..18: mol_type = other DNA
tttctcgtctcactatag

SEQ ID NO: 65426 - DNA, 18 bp, synthetic construct
  source 1..18: mol_type = other DNA
tttgaagaatcattacag

SEQ ID NO: 65427 - DNA, 18 bp, synthetic construct
  source 1..18: mol_type = other DNA
tttgtcgatacactaaag

SEQ ID NO: 65428 - DNA, 18 bp, synthetic construct
  source 1..18: mol_type = other DNA
ttttacatctcacaatag

SEQ ID NO: 65429 - DNA, 18 bp, synthetic construct
  source 1..18: mol_type = other DNA
ttttacgactaacacaag

SEQ ID NO: 65430 - DNA, 18 bp, synthetic construct
  source 1..18: mol_type = other DNA
ttttacgactagcactag

SEQ ID NO: 65431 - DNA, 18 bp, synthetic construct
  source 1..18: mol_type = other DNA
ttttacgactctcagtag

SEQ ID NO: 65432 - DNA, 18 bp, synthetic construct
  source 1..18: mol_type = other DNA
ttttacgactctctaagg

SEQ ID NO: 65433 - DNA, 18 bp, synthetic construct
  source 1..18: mol_type = other DNA
ttttacgacttcataaag

SEQ ID NO: 65434 - DNA, 18 bp, synthetic construct
  source 1..18: mol_type = other DNA
ttttacgatccactacag

SEQ ID NO: 65435 - DNA, 18 bp, synthetic construct
  source 1..18: mol_type = other DNA
ttttacgccactctatag

SEQ ID NO: 65436 - DNA, 18 bp, synthetic construct
  source 1..18: mol_type = other DNA
ttttactactcacaattg

SEQ ID NO: 65437 - DNA, 18 bp, synthetic construct
  source 1..18: mol_type = other DNA
ttttactactcaccttag

SEQ ID NO: 65438 - DNA, 18 bp, synthetic construct
  source 1..18: mol_type = other DNA
ttttaggactttctatag

SEQ ID NO: 65439 - DNA, 18 bp, synthetic construct
  source 1..18: mol_type = other DNA
ttttaggcccaactattg

SEQ ID NO: 65440 - DNA, 18 bp, synthetic construct
  source 1..18: mol_type = other DNA
ttttatgtctacctacag

SEQ ID NO: 65441 - DNA, 18 bp, synthetic construct
  source 1..18: mol_type = other DNA
ttttatgtctcacaatag

SEQ ID NO: 65442 - DNA, 18 bp, synthetic construct
  source 1..18: mol_type = other DNA
ttttccaactcaatatag

SEQ ID NO: 65443 - DNA, 18 bp, synthetic construct
  source 1..18: mol_type = other DNA
ttttcctactcaccattg

SEQ ID NO: 65444 - DNA, 18 bp, synthetic construct
  source 1..18: mol_type = other DNA
ttttctgtctcattatag

SEQ ID NO: 65445 - DNA, 18 bp, synthetic construct
  source 1..18: mol_type = other DNA
ttttgcggatcacttttg

SEQ ID NO: 65446 - DNA, 18 bp, synthetic construct
  source 1..18: mol_type = other DNA
tttttagaccgcctatag

SEQ ID NO: 65447 - DNA, 18 bp, synthetic construct
  source 1..18: mol_type = other DNA
tttttcgacttactattg

SEQ ID NO: 65448 - DNA, 18 bp, synthetic construct
  source 1..18: mol_type = other DNA
tttttcgtcatactatgg

SEQ ID NO: 65449 - DNA, 18 bp, synthetic construct
  source 1..18: mol_type = other DNA
ttttttgattctcaatag

SEQ ID NO: 65450 - DNA, 18 bp, synthetic construct
  source 1..18: mol_type = other DNA
ataaacgactctctctag

SEQ ID NO: 65451 - DNA, 18 bp, synthetic construct
  source 1..18: mol_type = other DNA
taataagacactttttag

SEQ ID NO: 65452 - DNA, 18 bp, synthetic construct
  source 1..18: mol_type = other DNA
aaatacaacaccctattg

SEQ ID NO: 65453 - DNA, 18 bp, synthetic construct
  source 1..18: mol_type = other DNA
aaatactacaaactttag

SEQ ID NO: 65454 - DNA, 18 bp, synthetic construct
  source 1..18: mol_type = other DNA
aagaacgactcaatttag

SEQ ID NO: 65455 - DNA, 18 bp, synthetic construct
  source 1..18: mol_type = other DNA
aataattgctcactatag

SEQ ID NO: 65456 - DNA, 18 bp, synthetic construct
  source 1..18: mol_type = other DNA
aattaagactctctattg

SEQ ID NO: 65457 - DNA, 18 bp, synthetic construct
  source 1..18: mol_type = other DNA
atatacgactttcaatag

SEQ ID NO: 65458 - DNA, 18 bp, synthetic construct
  source 1..18: mol_type = other DNA
atatattacacactattg

SEQ ID NO: 65459 - DNA, 18 bp, synthetic construct
  source 1..18: mol_type = other DNA
caatacgcctttcttttg

SEQ ID NO: 65460 - DNA, 18 bp, synthetic construct
  source 1..18: mol_type = other DNA
caattcgactctcattag

SEQ ID NO: 65461 - DNA, 18 bp, synthetic construct
  source 1..18: mol_type = other DNA
cattacgatacactatcg

SEQ ID NO: 65462 - DNA, 18 bp, synthetic construct
  source 1..18: mol_type = other DNA
catttagactcaccatag

SEQ ID NO: 65463 - DNA, 18 bp, synthetic construct
  source 1..18: mol_type = other DNA
gaattagactcactaatg

SEQ ID NO: 65464 - DNA, 18 bp, synthetic construct
  source 1..18: mol_type = other DNA
taaaacttctcacttcag

SEQ ID NO: 65465 - DNA, 18 bp, synthetic construct
  source 1..18: mol_type = other DNA
taactcgactctctcaag

SEQ ID NO: 65466 - DNA, 18 bp, synthetic construct
  source 1..18: mol_type = other DNA
taatacatttcattattg

SEQ ID NO: 65467 - DNA, 18 bp, synthetic construct
  source 1..18: mol_type = other DNA
taatacgaacgtcaatag

SEQ ID NO: 65468 - DNA, 18 bp, synthetic construct
  source 1..18: mol_type = other DNA
taatacgagcctgtattg

SEQ ID NO: 65469 - DNA, 18 bp, synthetic construct
  source 1..18: mol_type = other DNA
taatacgtctttcattag

SEQ ID NO: 65470 - DNA, 18 bp, synthetic construct
  source 1..18: mol_type = other DNA
taataggtcattctatag

SEQ ID NO: 65471 - DNA, 18 bp, synthetic construct
  source 1..18: mol_type = other DNA
taatatgactatctaatg

SEQ ID NO: 65472 - DNA, 18 bp, synthetic construct
  source 1..18: mol_type = other DNA
taattcgtttcacattag

SEQ ID NO: 65473 - DNA, 18 bp, synthetic construct
  source 1..18: mol_type = other DNA
tagatactctcaccaacg

SEQ ID NO: 65474 - DNA, 18 bp, synthetic construct
  source 1..18: mol_type = other DNA
tagtacgaatacgtatcg

SEQ ID NO: 65475 - DNA, 18 bp, synthetic construct
  source 1..18: mol_type = other DNA
tagttccattcacattag

SEQ ID NO: 65476 - DNA, 18 bp, synthetic construct
  source 1..18: mol_type = other DNA
tatgaagacttcccacag

SEQ ID NO: 65477 - DNA, 18 bp, synthetic construct
  source 1..18: mol_type = other DNA
tattaacacatacaatag

SEQ ID NO: 65478 - DNA, 18 bp, synthetic construct
  source 1..18: mol_type = other DNA
tattagatcttacttgag

SEQ ID NO: 65479 - DNA, 18 bp, synthetic construct
  source 1..18: mol_type = other DNA
tatttcatctcacaatag

SEQ ID NO: 65480 - DNA, 18 bp, synthetic construct
  source 1..18: mol_type = other DNA
tcatacatcatactatag

SEQ ID NO: 65481 - DNA, 18 bp, synthetic construct
  source 1..18: mol_type = other DNA
tcatattactcacaatgg

SEQ ID NO: 65482 - DNA, 18 bp, synthetic construct
  source 1..18: mol_type = other DNA
tgattcgatttacttcag

SEQ ID NO: 65483 - DNA, 18 bp, synthetic construct
  source 1..18: mol_type = other DNA
ttataagaatcactcttg

SEQ ID NO: 65484 - DNA, 18 bp, synthetic construct
  source 1..18: mol_type = other DNA
ttataagactgacttcag

SEQ ID NO: 65485 - DNA, 18 bp, synthetic construct
  source 1..18: mol_type = other DNA
ttatacgacacagaaatg

SEQ ID NO: 65486 - DNA, 18 bp, synthetic construct
  source 1..18: mol_type = other DNA
ttatacgtcacggtattg

SEQ ID NO: 65487 - DNA, 18 bp, synthetic construct
  source 1..18: mol_type = other DNA
ttcttcgactcgctttag

SEQ ID NO: 65488 - DNA, 18 bp, synthetic construct
  source 1..18: mol_type = other DNA
tttcacgactccaagtag

SEQ ID NO: 65489 - DNA, 18 bp, synthetic construct
  source 1..18: mol_type = other DNA
ttttacgacttacttttg

SEQ ID NO: 65490 - DNA, 18 bp, synthetic construct
  source 1..18: mol_type = other DNA
taatacgattctcttatg

SEQ ID NO: 65491 - DNA, 18 bp, synthetic construct
  source 1..18: mol_type = other DNA
tatttcgactcacttatg

SEQ ID NO: 65492 - DNA, 18 bp, synthetic construct
  source 1..18: mol_type = other DNA
ttttacgactctctagcg

SEQ ID NO: 65493 - DNA, 18 bp, synthetic construct
  source 1..18: mol_type = other DNA
aaatacgactgtctctcg

SEQ ID NO: 65494 - DNA, 18 bp, synthetic construct
  source 1..18: mol_type = other DNA
aaatatgagacacaatag

SEQ ID NO: 65495 - DNA, 18 bp, synthetic construct
  source 1..18: mol_type = other DNA
aaattcgtctgactacag

SEQ ID NO: 65496 - DNA, 18 bp, synthetic construct
  source 1..18: mol_type = other DNA
aagaacgactctctattg

SEQ ID NO: 65497 - DNA, 18 bp, synthetic construct
  source 1..18: mol_type = other DNA
atacacgacttccaatag

SEQ ID NO: 65498 - DNA, 18 bp, synthetic construct
  source 1..18: mol_type = other DNA
atattcgactctgtattg

SEQ ID NO: 65499 - DNA, 18 bp, synthetic construct
  source 1..18: mol_type = other DNA
atctacgacttacattag

SEQ ID NO: 65500 - DNA, 18 bp, synthetic construct
  source 1..18: mol_type = other DNA
attaaagcctcattgaag

SEQ ID NO: 65501 - DNA, 18 bp, synthetic construct
  source 1..18: mol_type = other DNA
caataaaactcactaatg

SEQ ID NO: 65502 - DNA, 18 bp, synthetic construct
  source 1..18: mol_type = other DNA
caattcgtctaaatatag

SEQ ID NO: 65503 - DNA, 18 bp, synthetic construct
  source 1..18: mol_type = other DNA
cgcaacgtcacacaacag

SEQ ID NO: 65504 - DNA, 18 bp, synthetic construct
  source 1..18: mol_type = other DNA
taaatcgtctcacttttg

SEQ ID NO: 65505 - DNA, 18 bp, synthetic construct
  source 1..18: mol_type = other DNA
taacacgacaaactaggg

SEQ ID NO: 65506 - DNA, 18 bp, synthetic construct
  source 1..18: mol_type = other DNA
taacacgtcatactttag

SEQ ID NO: 65507 - DNA, 18 bp, synthetic construct
  source 1..18: mol_type = other DNA
taatacgactttcatttg

SEQ ID NO: 65508 - DNA, 18 bp, synthetic construct
  source 1..18: mol_type = other DNA
taatacgattacttttcg

SEQ ID NO: 65509 - DNA, 18 bp, synthetic construct
  source 1..18: mol_type = other DNA
taatactccccagtattg

SEQ ID NO: 65510 - DNA, 18 bp, synthetic construct
  source 1..18: mol_type = other DNA
taattcgacacgaaagag

SEQ ID NO: 65511 - DNA, 18 bp, synthetic construct
  source 1..18: mol_type = other DNA
taattcgactctcaaagg

SEQ ID NO: 65512 - DNA, 18 bp, synthetic construct
  source 1..18: mol_type = other DNA
taatttaacactctattg

SEQ ID NO: 65513 - DNA, 18 bp, synthetic construct
  source 1..18: mol_type = other DNA
tataacgattcacaacag

SEQ ID NO: 65514 - DNA, 18 bp, synthetic construct
  source 1..18: mol_type = other DNA
tataacgtctcacaattg

SEQ ID NO: 65515 - DNA, 18 bp, synthetic construct
  source 1..18: mol_type = other DNA
tataactactcactaatg

SEQ ID NO: 65516 - DNA, 18 bp, synthetic construct
  source 1..18: mol_type = other DNA
tataatgactcactgaag

SEQ ID NO: 65517 - DNA, 18 bp, synthetic construct
  source 1..18: mol_type = other DNA
tatatcgacccactaaag

SEQ ID NO: 65518 - DNA, 18 bp, synthetic construct
  source 1..18: mol_type = other DNA
tatatcgtctcactaaag

SEQ ID NO: 65519 - DNA, 18 bp, synthetic construct
  source 1..18: mol_type = other DNA
tatcacgactcacatttg

SEQ ID NO: 65520 - DNA, 18 bp, synthetic construct
  source 1..18: mol_type = other DNA
tatctcgactcacttttg

SEQ ID NO: 65521 - DNA, 18 bp, synthetic construct
  source 1..18: mol_type = other DNA
tattaatcctcactatcg

SEQ ID NO: 65522 - DNA, 18 bp, synthetic construct
  source 1..18: mol_type = other DNA
tattacgtctctcaatcg

SEQ ID NO: 65523 - DNA, 18 bp, synthetic construct
  source 1..18: mol_type = other DNA
tattactagtcactgatg

SEQ ID NO: 65524 - DNA, 18 bp, synthetic construct
  source 1..18: mol_type = other DNA
tattccgactcacgaatg

SEQ ID NO: 65525 - DNA, 18 bp, synthetic construct
  source 1..18: mol_type = other DNA
tattgacactcactattg

SEQ ID NO: 65526 - DNA, 18 bp, synthetic construct
  source 1..18: mol_type = other DNA
tattttgactcattaaag

SEQ ID NO: 65527 - DNA, 18 bp, synthetic construct
  source 1..18: mol_type = other DNA
tcaatcgactcattattg

SEQ ID NO: 65528 - DNA, 18 bp, synthetic construct
  source 1..18: mol_type = other DNA
tcacaggactcgcattag

SEQ ID NO: 65529 - DNA, 18 bp, synthetic construct
  source 1..18: mol_type = other DNA
tgatgcaactcgctactg

SEQ ID NO: 65530 - DNA, 18 bp, synthetic construct
  source 1..18: mol_type = other DNA
ttactcgacgctcaatag

SEQ ID NO: 65531 - DNA, 18 bp, synthetic construct
  source 1..18: mol_type = other DNA
ttataagacttactcaag

SEQ ID NO: 65532 - DNA, 18 bp, synthetic construct
  source 1..18: mol_type = other DNA
ttatacaaatcactaatg

SEQ ID NO: 65533 - DNA, 18 bp, synthetic construct
  source 1..18: mol_type = other DNA
ttatacaattcccaatag

SEQ ID NO: 65534 - DNA, 18 bp, synthetic construct
  source 1..18: mol_type = other DNA
ttataccactctctaagg

SEQ ID NO: 65535 - DNA, 18 bp, synthetic construct
  source 1..18: mol_type = other DNA
ttatacgatttacttttg

SEQ ID NO: 65536 - DNA, 18 bp, synthetic construct
  source 1..18: mol_type = other DNA
ttatactcctctctaaag

SEQ ID NO: 65537 - DNA, 18 bp, synthetic construct
  source 1..18: mol_type = other DNA
ttatacttcaccctatag

SEQ ID NO: 65538 - DNA, 18 bp, synthetic construct
  source 1..18: mol_type = other DNA
ttatataacatactttcg

SEQ ID NO: 65539 - DNA, 18 bp, synthetic construct
  source 1..18: mol_type = other DNA
ttatatgatccactaatg

SEQ ID NO: 65540 - DNA, 18 bp, synthetic construct
  source 1..18: mol_type = other DNA
ttatttgtctcattatag

SEQ ID NO: 65541 - DNA, 18 bp, synthetic construct
  source 1..18: mol_type = other DNA
ttttactccccactatag

SEQ ID NO: 65542 - DNA, 18 bp, synthetic construct
  source 1..18: mol_type = other DNA
aaaaaagactctcttaag

SEQ ID NO: 65543 - DNA, 18 bp, synthetic construct
  source 1..18: mol_type = other DNA
aaaaacgcctctttatgg

SEQ ID NO: 65544 - DNA, 18 bp, synthetic construct
  source 1..18: mol_type = other DNA
aaaaacgtatcactttag

SEQ ID NO: 65545 - DNA, 18 bp, synthetic construct
  source 1..18: mol_type = other DNA
aaaaacgtctctatatag

SEQ ID NO: 65546 - DNA, 18 bp, synthetic construct
  source 1..18: mol_type = other DNA
aaaaacgttttactatag

SEQ ID NO: 65547 - DNA, 18 bp, synthetic construct
  source 1..18: mol_type = other DNA
aaaaactactcaatttag

SEQ ID NO: 65548 - DNA, 18 bp, synthetic construct
  source 1..18: mol_type = other DNA
aaaaccggcacactattg

SEQ ID NO: 65549 - DNA, 18 bp, synthetic construct
  source 1..18: mol_type = other DNA
aaaatcgactcactcttg

SEQ ID NO: 65550 - DNA, 18 bp, synthetic construct
  source 1..18: mol_type = other DNA
aaaatcgcgcctcaaaag

SEQ ID NO: 65551 - DNA, 18 bp, synthetic construct
  source 1..18: mol_type = other DNA
aaaatcgtatccattttg

SEQ ID NO: 65552 - DNA, 18 bp, synthetic construct
  source 1..18: mol_type = other DNA
aaaatcttatcaatatag

SEQ ID NO: 65553 - DNA, 18 bp, synthetic construct
  source 1..18: mol_type = other DNA
aaacaagactctcaatag

SEQ ID NO: 65554 - DNA, 18 bp, synthetic construct
  source 1..18: mol_type = other DNA
aaacacgaagcactttag

SEQ ID NO: 65555 - DNA, 18 bp, synthetic construct
  source 1..18: mol_type = other DNA
aaacacggggcgcaatag

SEQ ID NO: 65556 - DNA, 18 bp, synthetic construct
  source 1..18: mol_type = other DNA
aaacacgtctgaatatag

SEQ ID NO: 65557 - DNA, 18 bp, synthetic construct
  source 1..18: mol_type = other DNA
aaacacgtttcacttcag

SEQ ID NO: 65558 - DNA, 18 bp, synthetic construct
  source 1..18: mol_type = other DNA
aaacatgacttactaaag

SEQ ID NO: 65559 - DNA, 18 bp, synthetic construct
  source 1..18: mol_type = other DNA
aaacattactcattatcg

SEQ ID NO: 65560 - DNA, 18 bp, synthetic construct
  source 1..18: mol_type = other DNA
aaacgcgactaactattg

SEQ ID NO: 65561 - DNA, 18 bp, synthetic construct
  source 1..18: mol_type = other DNA
aaacgtgactatctatcg

SEQ ID NO: 65562 - DNA, 18 bp, synthetic construct
  source 1..18: mol_type = other DNA
aaactcgaaacattatag

SEQ ID NO: 65563 - DNA, 18 bp, synthetic construct
  source 1..18: mol_type = other DNA
aaactcgactcaccatcg

SEQ ID NO: 65564 - DNA, 18 bp, synthetic construct
  source 1..18: mol_type = other DNA
aaactcgactcacttatg

SEQ ID NO: 65565 - DNA, 18 bp, synthetic construct
  source 1..18: mol_type = other DNA
aaacttgattctctaaag

SEQ ID NO: 65566 - DNA, 18 bp, synthetic construct
  source 1..18: mol_type = other DNA
aaacttgcaacactatag

SEQ ID NO: 65567 - DNA, 18 bp, synthetic construct
  source 1..18: mol_type = other DNA
aaagacaattcgttttag

SEQ ID NO: 65568 - DNA, 18 bp, synthetic construct
  source 1..18: mol_type = other DNA
aaagacgacttttaatag

SEQ ID NO: 65569 - DNA, 18 bp, synthetic construct
  source 1..18: mol_type = other DNA
aaagacgcatgactattg

SEQ ID NO: 65570 - DNA, 18 bp, synthetic construct
  source 1..18: mol_type = other DNA
aaagacgtcacataatag

SEQ ID NO: 65571 - DNA, 18 bp, synthetic construct
  source 1..18: mol_type = other DNA
aaagtcaacactataaag

SEQ ID NO: 65572 - DNA, 18 bp, synthetic construct
  source 1..18: mol_type = other DNA
aaagtccactccctagtg

SEQ ID NO: 65573 - DNA, 18 bp, synthetic construct
  source 1..18: mol_type = other DNA
aaagtcgtctccccatag

SEQ ID NO: 65574 - DNA, 18 bp, synthetic construct
  source 1..18: mol_type = other DNA
aaataacgcagactaatg

SEQ ID NO: 65575 - DNA, 18 bp, synthetic construct
  source 1..18: mol_type = other DNA
aaataagaatcacaaaag

SEQ ID NO: 65576 - DNA, 18 bp, synthetic construct
  source 1..18: mol_type = other DNA
aaataagaatcacttaag

SEQ ID NO: 65577 - DNA, 18 bp, synthetic construct
  source 1..18: mol_type = other DNA
aaataagacttccaaatg

SEQ ID NO: 65578 - DNA, 18 bp, synthetic construct
  source 1..18: mol_type = other DNA
aaataagcgccactatag

SEQ ID NO: 65579 - DNA, 18 bp, synthetic construct
  source 1..18: mol_type = other DNA
aaataaggctctttaaag

SEQ ID NO: 65580 - DNA, 18 bp, synthetic construct
  source 1..18: mol_type = other DNA
aaatacaaatgacttatg

SEQ ID NO: 65581 - DNA, 18 bp, synthetic construct
  source 1..18: mol_type = other DNA
aaatacaactcccctctg

SEQ ID NO: 65582 - DNA, 18 bp, synthetic construct
  source 1..18: mol_type = other DNA
aaataccacttcctttag

SEQ ID NO: 65583 - DNA, 18 bp, synthetic construct
  source 1..18: mol_type = other DNA
aaatacctctcataatag

SEQ ID NO: 65584 - DNA, 18 bp, synthetic construct
  source 1..18: mol_type = other DNA
aaatacgaaacattcttg

SEQ ID NO: 65585 - DNA, 18 bp, synthetic construct
  source 1..18: mol_type = other DNA
aaatacgaaactctctgg

SEQ ID NO: 65586 - DNA, 18 bp, synthetic construct
  source 1..18: mol_type = other DNA
aaatacgaatctttatgg

SEQ ID NO: 65587 - DNA, 18 bp, synthetic construct
  source 1..18: mol_type = other DNA
aaatacgaatttcaatag

SEQ ID NO: 65588 - DNA, 18 bp, synthetic construct
  source 1..18: mol_type = other DNA
aaatacgacactcctatg

SEQ ID NO: 65589 - DNA, 18 bp, synthetic construct
  source 1..18: mol_type = other DNA
aaatacgaccctcaaaag

SEQ ID NO: 65590 - DNA, 18 bp, synthetic construct
  source 1..18: mol_type = other DNA
aaatacgacgctttcttg

SEQ ID NO: 65591 - DNA, 18 bp, synthetic construct
  source 1..18: mol_type = other DNA
aaatacgactatctagcg

SEQ ID NO: 65592 - DNA, 18 bp, synthetic construct
  source 1..18: mol_type = other DNA
aaatacgactatcttttg

SEQ ID NO: 65593 - DNA, 18 bp, synthetic construct
  source 1..18: mol_type = other DNA
aaatacgactcataactg

SEQ ID NO: 65594 - DNA, 18 bp, synthetic construct
  source 1..18: mol_type = other DNA
aaatacgagtatctttag

SEQ ID NO: 65595 - DNA, 18 bp, synthetic construct
  source 1..18: mol_type = other DNA
aaatacgatacagtaaag

SEQ ID NO: 65596 - DNA, 18 bp, synthetic construct
  source 1..18: mol_type = other DNA
aaatacggatccttattg

SEQ ID NO: 65597 - DNA, 18 bp, synthetic construct
  source 1..18: mol_type = other DNA
aaatacggcacacctcag

SEQ ID NO: 65598 - DNA, 18 bp, synthetic construct
  source 1..18: mol_type = other DNA
aaatacggctctcaacag

SEQ ID NO: 65599 - DNA, 18 bp, synthetic construct
  source 1..18: mol_type = other DNA
aaatacgtatatctattg

SEQ ID NO: 65600 - DNA, 18 bp, synthetic construct
  source 1..18: mol_type = other DNA
aaatacgtctaattatgg

SEQ ID NO: 65601 - DNA, 18 bp, synthetic construct
  source 1..18: mol_type = other DNA
aaatacgtctcatcagag

SEQ ID NO: 65602 - DNA, 18 bp, synthetic construct
  source 1..18: mol_type = other DNA
aaatacgtctcgttaaag

SEQ ID NO: 65603 - DNA, 18 bp, synthetic construct
  source 1..18: mol_type = other DNA
aaatacgtcttaataatg

SEQ ID NO: 65604 - DNA, 18 bp, synthetic construct
  source 1..18: mol_type = other DNA
aaatactacactccgtag

SEQ ID NO: 65605 - DNA, 18 bp, synthetic construct
  source 1..18: mol_type = other DNA
aaatactacccattgtag

SEQ ID NO: 65606 - DNA, 18 bp, synthetic construct
  source 1..18: mol_type = other DNA
aaatactacgctttaaag

SEQ ID NO: 65607 - DNA, 18 bp, synthetic construct
  source 1..18: mol_type = other DNA
aaatactactcccatttg

SEQ ID NO: 65608 - DNA, 18 bp, synthetic construct
  source 1..18: mol_type = other DNA
aaatactacttcctgtag

SEQ ID NO: 65609 - DNA, 18 bp, synthetic construct
  source 1..18: mol_type = other DNA
aaatactcctcatttaag

SEQ ID NO: 65610 - DNA, 18 bp, synthetic construct
  source 1..18: mol_type = other DNA
aaatagatcacattaaag

SEQ ID NO: 65611 - DNA, 18 bp, synthetic construct
  source 1..18: mol_type = other DNA
aaatagggctcgcaatag

SEQ ID NO: 65612 - DNA, 18 bp, synthetic construct
  source 1..18: mol_type = other DNA
aaatagtaaacacaattg

SEQ ID NO: 65613 - DNA, 18 bp, synthetic construct
  source 1..18: mol_type = other DNA
aaatagtactcacaaaag

SEQ ID NO: 65614 - DNA, 18 bp, synthetic construct
  source 1..18: mol_type = other DNA
aaatatgtcactcaactg

SEQ ID NO: 65615 - DNA, 18 bp, synthetic construct
  source 1..18: mol_type = other DNA
aaatattactaactaaag

SEQ ID NO: 65616 - DNA, 18 bp, synthetic construct
  source 1..18: mol_type = other DNA
aaatattactcaccaaag

SEQ ID NO: 65617 - DNA, 18 bp, synthetic construct
  source 1..18: mol_type = other DNA
aaatcagtatcactgtag

SEQ ID NO: 65618 - DNA, 18 bp, synthetic construct
  source 1..18: mol_type = other DNA
aaatcccactatttattg

SEQ ID NO: 65619 - DNA, 18 bp, synthetic construct
  source 1..18: mol_type = other DNA
aaatccgacacaaaatgg

SEQ ID NO: 65620 - DNA, 18 bp, synthetic construct
  source 1..18: mol_type = other DNA
aaatccgactcacccttg

SEQ ID NO: 65621 - DNA, 18 bp, synthetic construct
  source 1..18: mol_type = other DNA
aaatcctaacatctatcg

SEQ ID NO: 65622 - DNA, 18 bp, synthetic construct
  source 1..18: mol_type = other DNA
aaatcgtattgatcatag

SEQ ID NO: 65623 - DNA, 18 bp, synthetic construct
  source 1..18: mol_type = other DNA
aaatgcgactcacaactg

SEQ ID NO: 65624 - DNA, 18 bp, synthetic construct
  source 1..18: mol_type = other DNA
aaatgcgatttactttag

SEQ ID NO: 65625 - DNA, 18 bp, synthetic construct
  source 1..18: mol_type = other DNA
aaatgtgattatcaatag

SEQ ID NO: 65626 - DNA, 18 bp, synthetic construct
  source 1..18: mol_type = other DNA
aaatgtgtgtcgcagtag

SEQ ID NO: 65627 - DNA, 18 bp, synthetic construct
  source 1..18: mol_type = other DNA
aaattagacatactttag

SEQ ID NO: 65628 - DNA, 18 bp, synthetic construct
  source 1..18: mol_type = other DNA
aaattcaagtctctaaag

SEQ ID NO: 65629 - DNA, 18 bp, synthetic construct
  source 1..18: mol_type = other DNA
aaattccaatcacaatag

SEQ ID NO: 65630 - DNA, 18 bp, synthetic construct
  source 1..18: mol_type = other DNA
aaattccagacactaaag

SEQ ID NO: 65631 - DNA, 18 bp, synthetic construct
  source 1..18: mol_type = other DNA
aaattcctctcactattg

SEQ ID NO: 65632 - DNA, 18 bp, synthetic construct
  source 1..18: mol_type = other DNA
aaattcgaatcacaagag

SEQ ID NO: 65633 - DNA, 18 bp, synthetic construct
  source 1..18: mol_type = other DNA
aaattcgacaaacacttg

SEQ ID NO: 65634 - DNA, 18 bp, synthetic construct
  source 1..18: mol_type = other DNA
aaattcgacattctatag

SEQ ID NO: 65635 - DNA, 18 bp, synthetic construct
  source 1..18: mol_type = other DNA
aaattcgactacctacag

SEQ ID NO: 65636 - DNA, 18 bp, synthetic construct
  source 1..18: mol_type = other DNA
aaattcgagactttacag

SEQ ID NO: 65637 - DNA, 18 bp, synthetic construct
  source 1..18: mol_type = other DNA
aaattcgtcccaatatgg

SEQ ID NO: 65638 - DNA, 18 bp, synthetic construct
  source 1..18: mol_type = other DNA
aaattcgtcccactattg

SEQ ID NO: 65639 - DNA, 18 bp, synthetic construct
  source 1..18: mol_type = other DNA
aaattcgtctctctttag

SEQ ID NO: 65640 - DNA, 18 bp, synthetic construct
  source 1..18: mol_type = other DNA
aaattctactcactttcg

SEQ ID NO: 65641 - DNA, 18 bp, synthetic construct
  source 1..18: mol_type = other DNA
aaattctgctagctatag

SEQ ID NO: 65642 - DNA, 18 bp, synthetic construct
  source 1..18: mol_type = other DNA
aaatttgactcgctaatg

SEQ ID NO: 65643 - DNA, 18 bp, synthetic construct
  source 1..18: mol_type = other DNA
aaatttgacttacaatag

SEQ ID NO: 65644 - DNA, 18 bp, synthetic construct
  source 1..18: mol_type = other DNA
aaatttgtttaacattag

SEQ ID NO: 65645 - DNA, 18 bp, synthetic construct
  source 1..18: mol_type = other DNA
aacaacgacacactaaag

SEQ ID NO: 65646 - DNA, 18 bp, synthetic construct
  source 1..18: mol_type = other DNA
aacaactacattctatag

SEQ ID NO: 65647 - DNA, 18 bp, synthetic construct
  source 1..18: mol_type = other DNA
aacaatgacactctatag

SEQ ID NO: 65648 - DNA, 18 bp, synthetic construct
  source 1..18: mol_type = other DNA
aacatcgtctcactatag

SEQ ID NO: 65649 - DNA, 18 bp, synthetic construct
  source 1..18: mol_type = other DNA
aacattgactcactatag

SEQ ID NO: 65650 - DNA, 18 bp, synthetic construct
  source 1..18: mol_type = other DNA
aacgaatgctaagtatag

SEQ ID NO: 65651 - DNA, 18 bp, synthetic construct
  source 1..18: mol_type = other DNA
aacgactacaaagtatgg

SEQ ID NO: 65652 - DNA, 18 bp, synthetic construct
  source 1..18: mol_type = other DNA
aactaaaactcacaatag

SEQ ID NO: 65653 - DNA, 18 bp, synthetic construct
  source 1..18: mol_type = other DNA
aactacagcccactttcg

SEQ ID NO: 65654 - DNA, 18 bp, synthetic construct
  source 1..18: mol_type = other DNA
aactacgaaagactatag

SEQ ID NO: 65655 - DNA, 18 bp, synthetic construct
  source 1..18: mol_type = other DNA
aactacgtctctctttag

SEQ ID NO: 65656 - DNA, 18 bp, synthetic construct
  source 1..18: mol_type = other DNA
aactgcaattcattagag

SEQ ID NO: 65657 - DNA, 18 bp, synthetic construct
  source 1..18: mol_type = other DNA
aactgtgtctcactattg

SEQ ID NO: 65658 - DNA, 18 bp, synthetic construct
  source 1..18: mol_type = other DNA
aacttcgaatctctatag

SEQ ID NO: 65659 - DNA, 18 bp, synthetic construct
  source 1..18: mol_type = other DNA
aagaaagtttccttaaag

SEQ ID NO: 65660 - DNA, 18 bp, synthetic construct
  source 1..18: mol_type = other DNA
aagaacgaccgactacag

SEQ ID NO: 65661 - DNA, 18 bp, synthetic construct
  source 1..18: mol_type = other DNA
aagaacgattcaccttag

SEQ ID NO: 65662 - DNA, 18 bp, synthetic construct
  source 1..18: mol_type = other DNA
aagatcgaaacactaaag

SEQ ID NO: 65663 - DNA, 18 bp, synthetic construct
  source 1..18: mol_type = other DNA
aagatcgacacacaaagg

SEQ ID NO: 65664 - DNA, 18 bp, synthetic construct
  source 1..18: mol_type = other DNA
aagatcgattcactatcg

SEQ ID NO: 65665 - DNA, 18 bp, synthetic construct
  source 1..18: mol_type = other DNA
aagcaccaatcacttttg

SEQ ID NO: 65666 - DNA, 18 bp, synthetic construct
  source 1..18: mol_type = other DNA
aagtaagattcacacgtg

SEQ ID NO: 65667 - DNA, 18 bp, synthetic construct
  source 1..18: mol_type = other DNA
aagtaattaatactttag

SEQ ID NO: 65668 - DNA, 18 bp, synthetic construct
  source 1..18: mol_type = other DNA
aagtacgactcacgtaag

SEQ ID NO: 65669 - DNA, 18 bp, synthetic construct
  source 1..18: mol_type = other DNA
aagtacgactctcaattg

SEQ ID NO: 65670 - DNA, 18 bp, synthetic construct
  source 1..18: mol_type = other DNA
aagtacgattcacataag

SEQ ID NO: 65671 - DNA, 18 bp, synthetic construct
  source 1..18: mol_type = other DNA
aagtacgtctcgttctag

SEQ ID NO: 65672 - DNA, 18 bp, synthetic construct
  source 1..18: mol_type = other DNA
aagtaggacttggtatag

SEQ ID NO: 65673 - DNA, 18 bp, synthetic construct
  source 1..18: mol_type = other DNA
aagtgcaacccactatag

SEQ ID NO: 65674 - DNA, 18 bp, synthetic construct
  source 1..18: mol_type = other DNA
aagttcgaaaatgtatag

SEQ ID NO: 65675 - DNA, 18 bp, synthetic construct
  source 1..18: mol_type = other DNA
aagttcgactcctgatag

SEQ ID NO: 65676 - DNA, 18 bp, synthetic construct
  source 1..18: mol_type = other DNA
aataaagactcactacag

SEQ ID NO: 65677 - DNA, 18 bp, synthetic construct
  source 1..18: mol_type = other DNA
aataacggttcacaatcg

SEQ ID NO: 65678 - DNA, 18 bp, synthetic construct
  source 1..18: mol_type = other DNA
aataatggctccctttag

SEQ ID NO: 65679 - DNA, 18 bp, synthetic construct
  source 1..18: mol_type = other DNA
aatatcaagtcactatgg

SEQ ID NO: 65680 - DNA, 18 bp, synthetic construct
  source 1..18: mol_type = other DNA
aatatcgtctcactctag

SEQ ID NO: 65681 - DNA, 18 bp, synthetic construct
  source 1..18: mol_type = other DNA
aatcacgactctcttcag

SEQ ID NO: 65682 - DNA, 18 bp, synthetic construct
  source 1..18: mol_type = other DNA
aattaaaactaactctag

SEQ ID NO: 65683 - DNA, 18 bp, synthetic construct
  source 1..18: mol_type = other DNA
aattacatccctcaacag

SEQ ID NO: 65684 - DNA, 18 bp, synthetic construct
  source 1..18: mol_type = other DNA
aattacatctcactaatg

SEQ ID NO: 65685 - DNA, 18 bp, synthetic construct
  source 1..18: mol_type = other DNA
aattaccgctcacttcag

SEQ ID NO: 65686 - DNA, 18 bp, synthetic construct
  source 1..18: mol_type = other DNA
aattacgaatcagtaaag

SEQ ID NO: 65687 - DNA, 18 bp, synthetic construct
  source 1..18: mol_type = other DNA
aattacgacacacataag

SEQ ID NO: 65688 - DNA, 18 bp, synthetic construct
  source 1..18: mol_type = other DNA
aattacgactaactcttg

SEQ ID NO: 65689 - DNA, 18 bp, synthetic construct
  source 1..18: mol_type = other DNA
aattacgagtgtttattg

SEQ ID NO: 65690 - DNA, 18 bp, synthetic construct
  source 1..18: mol_type = other DNA
aattacgatccacaaaag

SEQ ID NO: 65691 - DNA, 18 bp, synthetic construct
  source 1..18: mol_type = other DNA
aattacgattcattatcg

SEQ ID NO: 65692 - DNA, 18 bp, synthetic construct
  source 1..18: mol_type = other DNA
aattacgcctgactattg

SEQ ID NO: 65693 - DNA, 18 bp, synthetic construct
  source 1..18: mol_type = other DNA
aattacgtctaactatcg

SEQ ID NO: 65694 - DNA, 18 bp, synthetic construct
  source 1..18: mol_type = other DNA
aattactagacactttag

SEQ ID NO: 65695 - DNA, 18 bp, synthetic construct
  source 1..18: mol_type = other DNA
aattactcctgtctatag

SEQ ID NO: 65696 - DNA, 18 bp, synthetic construct
  source 1..18: mol_type = other DNA
aattactgcacactatag

SEQ ID NO: 65697 - DNA, 18 bp, synthetic construct
  source 1..18: mol_type = other DNA
aattataacacactatag

SEQ ID NO: 65698 - DNA, 18 bp, synthetic construct
  source 1..18: mol_type = other DNA
aattataattcactttag

SEQ ID NO: 65699 - DNA, 18 bp, synthetic construct
  source 1..18: mol_type = other DNA
aattatcactaacaatag

SEQ ID NO: 65700 - DNA, 18 bp, synthetic construct
  source 1..18: mol_type = other DNA
aattatgtctaactctag

SEQ ID NO: 65701 - DNA, 18 bp, synthetic construct
  source 1..18: mol_type = other DNA
aattccgacacactctag

SEQ ID NO: 65702 - DNA, 18 bp, synthetic construct
  source 1..18: mol_type = other DNA
aattccgactcacaaaag

SEQ ID NO: 65703 - DNA, 18 bp, synthetic construct
  source 1..18: mol_type = other DNA
aatttagtctctctaaag

SEQ ID NO: 65704 - DNA, 18 bp, synthetic construct
  source 1..18: mol_type = other DNA
aatttcgacgcacgatag

SEQ ID NO: 65705 - DNA, 18 bp, synthetic construct
  source 1..18: mol_type = other DNA
aatttcgacgctctatag

SEQ ID NO: 65706 - DNA, 18 bp, synthetic construct
  source 1..18: mol_type = other DNA
aatttcgagacactatag

SEQ ID NO: 65707 - DNA, 18 bp, synthetic construct
  source 1..18: mol_type = other DNA
aatttcgtctcaccaatg

SEQ ID NO: 65708 - DNA, 18 bp, synthetic construct
  source 1..18: mol_type = other DNA
aatttcttcacactttag

SEQ ID NO: 65709 - DNA, 18 bp, synthetic construct
  source 1..18: mol_type = other DNA
acaataaactcactacag

SEQ ID NO: 65710 - DNA, 18 bp, synthetic construct
  source 1..18: mol_type = other DNA
acaatggacaccctttag

SEQ ID NO: 65711 - DNA, 18 bp, synthetic construct
  source 1..18: mol_type = other DNA
acacactactcaccattg

SEQ ID NO: 65712 - DNA, 18 bp, synthetic construct
  source 1..18: mol_type = other DNA
acacactactctctatag

SEQ ID NO: 65713 - DNA, 18 bp, synthetic construct
  source 1..18: mol_type = other DNA
acagacgtcactatatag

SEQ ID NO: 65714 - DNA, 18 bp, synthetic construct
  source 1..18: mol_type = other DNA
acagatgacacgctatag

SEQ ID NO: 65715 - DNA, 18 bp, synthetic construct
  source 1..18: mol_type = other DNA
acataagactaactaaag

SEQ ID NO: 65716 - DNA, 18 bp, synthetic construct
  source 1..18: mol_type = other DNA
acataagacttcttatag

SEQ ID NO: 65717 - DNA, 18 bp, synthetic construct
  source 1..18: mol_type = other DNA
acataagcctcagtattg

SEQ ID NO: 65718 - DNA, 18 bp, synthetic construct
  source 1..18: mol_type = other DNA
acatacgacacactcctg

SEQ ID NO: 65719 - DNA, 18 bp, synthetic construct
  source 1..18: mol_type = other DNA
acatacgacacactcgag

SEQ ID NO: 65720 - DNA, 18 bp, synthetic construct
  source 1..18: mol_type = other DNA
acatacggctttctttag

SEQ ID NO: 65721 - DNA, 18 bp, synthetic construct
  source 1..18: mol_type = other DNA
acatagtatgcattggag

SEQ ID NO: 65722 - DNA, 18 bp, synthetic construct
  source 1..18: mol_type = other DNA
acatatggctcagtatgg

SEQ ID NO: 65723 - DNA, 18 bp, synthetic construct
  source 1..18: mol_type = other DNA
acatatgtcccacaatag

SEQ ID NO: 65724 - DNA, 18 bp, synthetic construct
  source 1..18: mol_type = other DNA
acatgcaacttactatag

SEQ ID NO: 65725 - DNA, 18 bp, synthetic construct
  source 1..18: mol_type = other DNA
acattataatgactaaag

SEQ ID NO: 65726 - DNA, 18 bp, synthetic construct
  source 1..18: mol_type = other DNA
acattcgacacattaaag

SEQ ID NO: 65727 - DNA, 18 bp, synthetic construct
  source 1..18: mol_type = other DNA
accgacgaatcgatatag

SEQ ID NO: 65728 - DNA, 18 bp, synthetic construct
  source 1..18: mol_type = other DNA
acctacgaatcccaaaag

SEQ ID NO: 65729 - DNA, 18 bp, synthetic construct
  source 1..18: mol_type = other DNA
actatggactatcttaag

SEQ ID NO: 65730 - DNA, 18 bp, synthetic construct
  source 1..18: mol_type = other DNA
actcactactctctaaag

SEQ ID NO: 65731 - DNA, 18 bp, synthetic construct
  source 1..18: mol_type = other DNA
actcactagtgactttag

SEQ ID NO: 65732 - DNA, 18 bp, synthetic construct
  source 1..18: mol_type = other DNA
agaatcgactcactctcg

SEQ ID NO: 65733 - DNA, 18 bp, synthetic construct
  source 1..18: mol_type = other DNA
agacaccagccattatag

SEQ ID NO: 65734 - DNA, 18 bp, synthetic construct
  source 1..18: mol_type = other DNA
agacacgaaacgcttcag

SEQ ID NO: 65735 - DNA, 18 bp, synthetic construct
  source 1..18: mol_type = other DNA
agagacgactctctaaag

SEQ ID NO: 65736 - DNA, 18 bp, synthetic construct
  source 1..18: mol_type = other DNA
agataagagagtctatag

SEQ ID NO: 65737 - DNA, 18 bp, synthetic construct
  source 1..18: mol_type = other DNA
agataagtctcacaatgg

SEQ ID NO: 65738 - DNA, 18 bp, synthetic construct
  source 1..18: mol_type = other DNA
agatacaactcacttttg

SEQ ID NO: 65739 - DNA, 18 bp, synthetic construct
  source 1..18: mol_type = other DNA
agatacgaatcgctctag

SEQ ID NO: 65740 - DNA, 18 bp, synthetic construct
  source 1..18: mol_type = other DNA
agatacgacccacttatg

SEQ ID NO: 65741 - DNA, 18 bp, synthetic construct
  source 1..18: mol_type = other DNA
agatacgactcttcctag

SEQ ID NO: 65742 - DNA, 18 bp, synthetic construct
  source 1..18: mol_type = other DNA
agatatgtcatactatag

SEQ ID NO: 65743 - DNA, 18 bp, synthetic construct
  source 1..18: mol_type = other DNA
agattcgactcataattg

SEQ ID NO: 65744 - DNA, 18 bp, synthetic construct
  source 1..18: mol_type = other DNA
agattcggttcactatag

SEQ ID NO: 65745 - DNA, 18 bp, synthetic construct
  source 1..18: mol_type = other DNA
agattgcactttctatag

SEQ ID NO: 65746 - DNA, 18 bp, synthetic construct
  source 1..18: mol_type = other DNA
agcgatgtctaacttgag

SEQ ID NO: 65747 - DNA, 18 bp, synthetic construct
  source 1..18: mol_type = other DNA
agctactacactctatag

SEQ ID NO: 65748 - DNA, 18 bp, synthetic construct
  source 1..18: mol_type = other DNA
agggacgtcttaatagcg

SEQ ID NO: 65749 - DNA, 18 bp, synthetic construct
  source 1..18: mol_type = other DNA
aggtccgacactctatag

SEQ ID NO: 65750 - DNA, 18 bp, synthetic construct
  source 1..18: mol_type = other DNA
ataaacgactgaccatag

SEQ ID NO: 65751 - DNA, 18 bp, synthetic construct
  source 1..18: mol_type = other DNA
ataaactactcagtttag

SEQ ID NO: 65752 - DNA, 18 bp, synthetic construct
  source 1..18: mol_type = other DNA
ataaacttctgcgcttag

SEQ ID NO: 65753 - DNA, 18 bp, synthetic construct
  source 1..18: mol_type = other DNA
atacacgacatagaatag

SEQ ID NO: 65754 - DNA, 18 bp, synthetic construct
  source 1..18: mol_type = other DNA
atactcgacttaccatag

SEQ ID NO: 65755 - DNA, 18 bp, synthetic construct
  source 1..18: mol_type = other DNA
atagatgactcactacag

SEQ ID NO: 65756 - DNA, 18 bp, synthetic construct
  source 1..18: mol_type = other DNA
atataagacacactacag

SEQ ID NO: 65757 - DNA, 18 bp, synthetic construct
  source 1..18: mol_type = other DNA
atataccaagcacaatgg

SEQ ID NO: 65758 - DNA, 18 bp, synthetic construct
  source 1..18: mol_type = other DNA
atataccagtcaatttag

SEQ ID NO: 65759 - DNA, 18 bp, synthetic construct
  source 1..18: mol_type = other DNA
atataccttttacattag

SEQ ID NO: 65760 - DNA, 18 bp, synthetic construct
  source 1..18: mol_type = other DNA
atatacgacatcctttag

SEQ ID NO: 65761 - DNA, 18 bp, synthetic construct
  source 1..18: mol_type = other DNA
atatacgacccgcttcag

SEQ ID NO: 65762 - DNA, 18 bp, synthetic construct
  source 1..18: mol_type = other DNA
atatacgactctgcatag

SEQ ID NO: 65763 - DNA, 18 bp, synthetic construct
  source 1..18: mol_type = other DNA
atatacgtcactctatag

SEQ ID NO: 65764 - DNA, 18 bp, synthetic construct
  source 1..18: mol_type = other DNA
atatacgtcatacgatag

SEQ ID NO: 65765 - DNA, 18 bp, synthetic construct
  source 1..18: mol_type = other DNA
atatataaatccctattg

SEQ ID NO: 65766 - DNA, 18 bp, synthetic construct
  source 1..18: mol_type = other DNA
atatatgactcattaaag

SEQ ID NO: 65767 - DNA, 18 bp, synthetic construct
  source 1..18: mol_type = other DNA
atatatgagtcgctgttg

SEQ ID NO: 65768 - DNA, 18 bp, synthetic construct
  source 1..18: mol_type = other DNA
atatatggctcttgaaag

SEQ ID NO: 65769 - DNA, 18 bp, synthetic construct
  source 1..18: mol_type = other DNA
atatccgacttactgtag

SEQ ID NO: 65770 - DNA, 18 bp, synthetic construct
  source 1..18: mol_type = other DNA
atatgagactctctatag

SEQ ID NO: 65771 - DNA, 18 bp, synthetic construct
  source 1..18: mol_type = other DNA
atatgcgacacgcagtag

SEQ ID NO: 65772 - DNA, 18 bp, synthetic construct
  source 1..18: mol_type = other DNA
atatgcgacagtaagtgg

SEQ ID NO: 65773 - DNA, 18 bp, synthetic construct
  source 1..18: mol_type = other DNA
atatgcgattccctatag

SEQ ID NO: 65774 - DNA, 18 bp, synthetic construct
  source 1..18: mol_type = other DNA
atatgcgtctcacaatag

SEQ ID NO: 65775 - DNA, 18 bp, synthetic construct
  source 1..18: mol_type = other DNA
atattagactcgctattg

SEQ ID NO: 65776 - DNA, 18 bp, synthetic construct
  source 1..18: mol_type = other DNA
atattagactctctatag

SEQ ID NO: 65777 - DNA, 18 bp, synthetic construct
  source 1..18: mol_type = other DNA
atattcgaatctgtccag

SEQ ID NO: 65778 - DNA, 18 bp, synthetic construct
  source 1..18: mol_type = other DNA
atattcgactctcttttg

SEQ ID NO: 65779 - DNA, 18 bp, synthetic construct
  source 1..18: mol_type = other DNA
atattcgacttagtattg

SEQ ID NO: 65780 - DNA, 18 bp, synthetic construct
  source 1..18: mol_type = other DNA
atcagcgactcactatag

SEQ ID NO: 65781 - DNA, 18 bp, synthetic construct
  source 1..18: mol_type = other DNA
atcatccactcacaaaag

SEQ ID NO: 65782 - DNA, 18 bp, synthetic construct
  source 1..18: mol_type = other DNA
atcctttactcactatag

SEQ ID NO: 65783 - DNA, 18 bp, synthetic construct
  source 1..18: mol_type = other DNA
atgaacgtctctctttcg

SEQ ID NO: 65784 - DNA, 18 bp, synthetic construct
  source 1..18: mol_type = other DNA
atgttcgtctcagtatag

SEQ ID NO: 65785 - DNA, 18 bp, synthetic construct
  source 1..18: mol_type = other DNA
attaacatctcagtatag

SEQ ID NO: 65786 - DNA, 18 bp, synthetic construct
  source 1..18: mol_type = other DNA
attgacgacgcacctttg

SEQ ID NO: 65787 - DNA, 18 bp, synthetic construct
  source 1..18: mol_type = other DNA
atttaccactcaatatag

SEQ ID NO: 65788 - DNA, 18 bp, synthetic construct
  source 1..18: mol_type = other DNA
atttacgacaaaccttag

SEQ ID NO: 65789 - DNA, 18 bp, synthetic construct
  source 1..18: mol_type = other DNA
atttacgactcataatag

SEQ ID NO: 65790 - DNA, 18 bp, synthetic construct
  source 1..18: mol_type = other DNA
atttacgcctcactaaag

SEQ ID NO: 65791 - DNA, 18 bp, synthetic construct
  source 1..18: mol_type = other DNA
atttactactctttatag

SEQ ID NO: 65792 - DNA, 18 bp, synthetic construct
  source 1..18: mol_type = other DNA
atttatgactcactttag

SEQ ID NO: 65793 - DNA, 18 bp, synthetic construct
  source 1..18: mol_type = other DNA
caaaacaactccataaag

SEQ ID NO: 65794 - DNA, 18 bp, synthetic construct
  source 1..18: mol_type = other DNA
caaaacgtcttgctattg

SEQ ID NO: 65795 - DNA, 18 bp, synthetic construct
  source 1..18: mol_type = other DNA
caaaaggactcttcaaag

SEQ ID NO: 65796 - DNA, 18 bp, synthetic construct
  source 1..18: mol_type = other DNA
caaaatgactcacgaaag

SEQ ID NO: 65797 - DNA, 18 bp, synthetic construct
  source 1..18: mol_type = other DNA
caaacccactcactaaag

SEQ ID NO: 65798 - DNA, 18 bp, synthetic construct
  source 1..18: mol_type = other DNA
caaatcaactcactttag

SEQ ID NO: 65799 - DNA, 18 bp, synthetic construct
  source 1..18: mol_type = other DNA
caacacgactcatactag

SEQ ID NO: 65800 - DNA, 18 bp, synthetic construct
  source 1..18: mol_type = other DNA
caacacgtctctttgtag

SEQ ID NO: 65801 - DNA, 18 bp, synthetic construct
  source 1..18: mol_type = other DNA
caacactactcactgtcg

SEQ ID NO: 65802 - DNA, 18 bp, synthetic construct
  source 1..18: mol_type = other DNA
caataacaatcaccaacg

SEQ ID NO: 65803 - DNA, 18 bp, synthetic construct
  source 1..18: mol_type = other DNA
caataacactcctaatag

SEQ ID NO: 65804 - DNA, 18 bp, synthetic construct
  source 1..18: mol_type = other DNA
caataagtatctctaaag

SEQ ID NO: 65805 - DNA, 18 bp, synthetic construct
  source 1..18: mol_type = other DNA
caataatacaaactatcg

SEQ ID NO: 65806 - DNA, 18 bp, synthetic construct
  source 1..18: mol_type = other DNA
caatacaatttattatag

SEQ ID NO: 65807 - DNA, 18 bp, synthetic construct
  source 1..18: mol_type = other DNA
caatacaccctactgaag

SEQ ID NO: 65808 - DNA, 18 bp, synthetic construct
  source 1..18: mol_type = other DNA
caatacgaaaaagtacag

SEQ ID NO: 65809 - DNA, 18 bp, synthetic construct
  source 1..18: mol_type = other DNA
caatacgaatcagtaatg

SEQ ID NO: 65810 - DNA, 18 bp, synthetic construct
  source 1..18: mol_type = other DNA
caatacgactcatatacg

SEQ ID NO: 65811 - DNA, 18 bp, synthetic construct
  source 1..18: mol_type = other DNA
caatacgactccgtaatg

SEQ ID NO: 65812 - DNA, 18 bp, synthetic construct
  source 1..18: mol_type = other DNA
caatacgacttataattg

SEQ ID NO: 65813 - DNA, 18 bp, synthetic construct
  source 1..18: mol_type = other DNA
caatacgacttatttaag

SEQ ID NO: 65814 - DNA, 18 bp, synthetic construct
  source 1..18: mol_type = other DNA
caatacgagattctatag

SEQ ID NO: 65815 - DNA, 18 bp, synthetic construct
  source 1..18: mol_type = other DNA
caatacgatacaccacag

SEQ ID NO: 65816 - DNA, 18 bp, synthetic construct
  source 1..18: mol_type = other DNA
caatactaatctcaatag

SEQ ID NO: 65817 - DNA, 18 bp, synthetic construct
  source 1..18: mol_type = other DNA
caatactactcaactcgg

SEQ ID NO: 65818 - DNA, 18 bp, synthetic construct
  source 1..18: mol_type = other DNA
caatactagtcacattag

SEQ ID NO: 65819 - DNA, 18 bp, synthetic construct
  source 1..18: mol_type = other DNA
caatacttttccctattg

SEQ ID NO: 65820 - DNA, 18 bp, synthetic construct
  source 1..18: mol_type = other DNA
caatgcgcctccttgatg

SEQ ID NO: 65821 - DNA, 18 bp, synthetic construct
  source 1..18: mol_type = other DNA
caatgcgcttccctatgg

SEQ ID NO: 65822 - DNA, 18 bp, synthetic construct
  source 1..18: mol_type = other DNA
caattattctcacaatag

SEQ ID NO: 65823 - DNA, 18 bp, synthetic construct
  source 1..18: mol_type = other DNA
caattcgacacaaattag

SEQ ID NO: 65824 - DNA, 18 bp, synthetic construct
  source 1..18: mol_type = other DNA
caattcgagcctcaaaag

SEQ ID NO: 65825 - DNA, 18 bp, synthetic construct
  source 1..18: mol_type = other DNA
caattcgtctcattattg

SEQ ID NO: 65826 - DNA, 18 bp, synthetic construct
  source 1..18: mol_type = other DNA
caattcgtttcacaacag

SEQ ID NO: 65827 - DNA, 18 bp, synthetic construct
  source 1..18: mol_type = other DNA
caattggacacgcgaaag

SEQ ID NO: 65828 - DNA, 18 bp, synthetic construct
  source 1..18: mol_type = other DNA
caatttggcacactatag

SEQ ID NO: 65829 - DNA, 18 bp, synthetic construct
  source 1..18: mol_type = other DNA
caatttgttaccataaag

SEQ ID NO: 65830 - DNA, 18 bp, synthetic construct
  source 1..18: mol_type = other DNA
caattttactcactactg

SEQ ID NO: 65831 - DNA, 18 bp, synthetic construct
  source 1..18: mol_type = other DNA
cacaaccacaaactatag

SEQ ID NO: 65832 - DNA, 18 bp, synthetic construct
  source 1..18: mol_type = other DNA
cacaacgacttacattag

SEQ ID NO: 65833 - DNA, 18 bp, synthetic construct
  source 1..18: mol_type = other DNA
cacagcgacaatctacag

SEQ ID NO: 65834 - DNA, 18 bp, synthetic construct
  source 1..18: mol_type = other DNA
cactaagcctccctattg

SEQ ID NO: 65835 - DNA, 18 bp, synthetic construct
  source 1..18: mol_type = other DNA
cactacaattcaccttag

SEQ ID NO: 65836 - DNA, 18 bp, synthetic construct
  source 1..18: mol_type = other DNA
cactacgtctcaacatag

SEQ ID NO: 65837 - DNA, 18 bp, synthetic construct
  source 1..18: mol_type = other DNA
cactacgtgtaacactag

SEQ ID NO: 65838 - DNA, 18 bp, synthetic construct
  source 1..18: mol_type = other DNA
cagtacgatttccaattg

SEQ ID NO: 65839 - DNA, 18 bp, synthetic construct
  source 1..18: mol_type = other DNA
cagtccgactcactacgg

SEQ ID NO: 65840 - DNA, 18 bp, synthetic construct
  source 1..18: mol_type = other DNA
cagttcgtgtctctatag

SEQ ID NO: 65841 - DNA, 18 bp, synthetic construct
  source 1..18: mol_type = other DNA
cataaagagtcacttacg

SEQ ID NO: 65842 - DNA, 18 bp, synthetic construct
  source 1..18: mol_type = other DNA
cataacgactcatttaag

SEQ ID NO: 65843 - DNA, 18 bp, synthetic construct
  source 1..18: mol_type = other DNA
catcacgactatctatag

SEQ ID NO: 65844 - DNA, 18 bp, synthetic construct
  source 1..18: mol_type = other DNA
catgccctcttacttttg

SEQ ID NO: 65845 - DNA, 18 bp, synthetic construct
  source 1..18: mol_type = other DNA
cattaatactcactacag

SEQ ID NO: 65846 - DNA, 18 bp, synthetic construct
  source 1..18: mol_type = other DNA
cattacatatcactgttg

SEQ ID NO: 65847 - DNA, 18 bp, synthetic construct
  source 1..18: mol_type = other DNA
cattacgacacaacatag

SEQ ID NO: 65848 - DNA, 18 bp, synthetic construct
  source 1..18: mol_type = other DNA
cattacgactatctaaag

SEQ ID NO: 65849 - DNA, 18 bp, synthetic construct
  source 1..18: mol_type = other DNA
cattacgatcctctatag

SEQ ID NO: 65850 - DNA, 18 bp, synthetic construct
  source 1..18: mol_type = other DNA
cattacgatgcactcaag

SEQ ID NO: 65851 - DNA, 18 bp, synthetic construct
  source 1..18: mol_type = other DNA
cattacgtcaaaatattg

SEQ ID NO: 65852 - DNA, 18 bp, synthetic construct
  source 1..18: mol_type = other DNA
cattactactcacaggag

SEQ ID NO: 65853 - DNA, 18 bp, synthetic construct
  source 1..18: mol_type = other DNA
cattaggagatgctagag

SEQ ID NO: 65854 - DNA, 18 bp, synthetic construct
  source 1..18: mol_type = other DNA
cattaggtttcaaaatag

SEQ ID NO: 65855 - DNA, 18 bp, synthetic construct
  source 1..18: mol_type = other DNA
cattatgactcaatctag

SEQ ID NO: 65856 - DNA, 18 bp, synthetic construct
  source 1..18: mol_type = other DNA
cattccatcacactatag

SEQ ID NO: 65857 - DNA, 18 bp, synthetic construct
  source 1..18: mol_type = other DNA
cattgcgactctctgtgg

SEQ ID NO: 65858 - DNA, 18 bp, synthetic construct
  source 1..18: mol_type = other DNA
catttcttcacaccaaag

SEQ ID NO: 65859 - DNA, 18 bp, synthetic construct
  source 1..18: mol_type = other DNA
ccaaacgtctcaataaag

SEQ ID NO: 65860 - DNA, 18 bp, synthetic construct
  source 1..18: mol_type = other DNA
ccaaacgtctcgttttgg

SEQ ID NO: 65861 - DNA, 18 bp, synthetic construct
  source 1..18: mol_type = other DNA
ccatgcgtccccctatag

SEQ ID NO: 65862 - DNA, 18 bp, synthetic construct
  source 1..18: mol_type = other DNA
cctaaggactccctaatg

SEQ ID NO: 65863 - DNA, 18 bp, synthetic construct
  source 1..18: mol_type = other DNA
ccttatgactctttaaag

SEQ ID NO: 65864 - DNA, 18 bp, synthetic construct
  source 1..18: mol_type = other DNA
cgataagactgactttag

SEQ ID NO: 65865 - DNA, 18 bp, synthetic construct
  source 1..18: mol_type = other DNA
cggtacgacacattatag

SEQ ID NO: 65866 - DNA, 18 bp, synthetic construct
  source 1..18: mol_type = other DNA
cgtttcaactcgctattg

SEQ ID NO: 65867 - DNA, 18 bp, synthetic construct
  source 1..18: mol_type = other DNA
ctaaacgacccactagtg

SEQ ID NO: 65868 - DNA, 18 bp, synthetic construct
  source 1..18: mol_type = other DNA
ctacactactcactctag

SEQ ID NO: 65869 - DNA, 18 bp, synthetic construct
  source 1..18: mol_type = other DNA
ctataatactctctatag

SEQ ID NO: 65870 - DNA, 18 bp, synthetic construct
  source 1..18: mol_type = other DNA
ctatacctgtgtccatag

SEQ ID NO: 65871 - DNA, 18 bp, synthetic construct
  source 1..18: mol_type = other DNA
ctatacgaaaaactcttg

SEQ ID NO: 65872 - DNA, 18 bp, synthetic construct
  source 1..18: mol_type = other DNA
ctatacgaatctctattg

SEQ ID NO: 65873 - DNA, 18 bp, synthetic construct
  source 1..18: mol_type = other DNA
ctatacgactaataatag

SEQ ID NO: 65874 - DNA, 18 bp, synthetic construct
  source 1..18: mol_type = other DNA
ctatacgactcaccttcg

SEQ ID NO: 65875 - DNA, 18 bp, synthetic construct
  source 1..18: mol_type = other DNA
ctatacgactcctttaag

SEQ ID NO: 65876 - DNA, 18 bp, synthetic construct
  source 1..18: mol_type = other DNA
ctatacgactctccctag

SEQ ID NO: 65877 - DNA, 18 bp, synthetic construct
  source 1..18: mol_type = other DNA
ctatacgacttacaattg

SEQ ID NO: 65878 - DNA, 18 bp, synthetic construct
  source 1..18: mol_type = other DNA
ctatacgtctgacaaaag

SEQ ID NO: 65879 - DNA, 18 bp, synthetic construct
  source 1..18: mol_type = other DNA
ctatactacacactttag

SEQ ID NO: 65880 - DNA, 18 bp, synthetic construct
  source 1..18: mol_type = other DNA
ctattcaactcagaatag

SEQ ID NO: 65881 - DNA, 18 bp, synthetic construct
  source 1..18: mol_type = other DNA
ctccatgattccctttcg

SEQ ID NO: 65882 - DNA, 18 bp, synthetic construct
  source 1..18: mol_type = other DNA
ctctatgactctacatag

SEQ ID NO: 65883 - DNA, 18 bp, synthetic construct
  source 1..18: mol_type = other DNA
cttaacgactcattctag

SEQ ID NO: 65884 - DNA, 18 bp, synthetic construct
  source 1..18: mol_type = other DNA
ctttaaaattcacactag

SEQ ID NO: 65885 - DNA, 18 bp, synthetic construct
  source 1..18: mol_type = other DNA
ctttaggactacctaaag

SEQ ID NO: 65886 - DNA, 18 bp, synthetic construct
  source 1..18: mol_type = other DNA
gaaaacgactatccaaag

SEQ ID NO: 65887 - DNA, 18 bp, synthetic construct
  source 1..18: mol_type = other DNA
gaaagcgtctcacaatag

SEQ ID NO: 65888 - DNA, 18 bp, synthetic construct
  source 1..18: mol_type = other DNA
gaacacctctcaccgaag

SEQ ID NO: 65889 - DNA, 18 bp, synthetic construct
  source 1..18: mol_type = other DNA
gaatacaatttactctcg

SEQ ID NO: 65890 - DNA, 18 bp, synthetic construct
  source 1..18: mol_type = other DNA
gaatacgtcccattaaag

SEQ ID NO: 65891 - DNA, 18 bp, synthetic construct
  source 1..18: mol_type = other DNA
gaatacgtgtcacctaag

SEQ ID NO: 65892 - DNA, 18 bp, synthetic construct
  source 1..18: mol_type = other DNA
gaatactaatgtctttag

SEQ ID NO: 65893 - DNA, 18 bp, synthetic construct
  source 1..18: mol_type = other DNA
gaatacttcaccctatag

SEQ ID NO: 65894 - DNA, 18 bp, synthetic construct
  source 1..18: mol_type = other DNA
gaattcgacccactgaag

SEQ ID NO: 65895 - DNA, 18 bp, synthetic construct
  source 1..18: mol_type = other DNA
gaattcgtcacacaatag

SEQ ID NO: 65896 - DNA, 18 bp, synthetic construct
  source 1..18: mol_type = other DNA
gactaaaactcacttaag

SEQ ID NO: 65897 - DNA, 18 bp, synthetic construct
  source 1..18: mol_type = other DNA
gactatgaaccactatgg

SEQ ID NO: 65898 - DNA, 18 bp, synthetic construct
  source 1..18: mol_type = other DNA
gacttcgagtcattttcg

SEQ ID NO: 65899 - DNA, 18 bp, synthetic construct
  source 1..18: mol_type = other DNA
gatatgtacaaactttag

SEQ ID NO: 65900 - DNA, 18 bp, synthetic construct
  source 1..18: mol_type = other DNA
gattactactcaatattg

SEQ ID NO: 65901 - DNA, 18 bp, synthetic construct
  source 1..18: mol_type = other DNA
gattattgcgcgctatag

SEQ ID NO: 65902 - DNA, 18 bp, synthetic construct
  source 1..18: mol_type = other DNA
gatttggactcaatttag

SEQ ID NO: 65903 - DNA, 18 bp, synthetic construct
  source 1..18: mol_type = other DNA
gcacacgacatactaaag

SEQ ID NO: 65904 - DNA, 18 bp, synthetic construct
  source 1..18: mol_type = other DNA
gcatacgactccttttag

SEQ ID NO: 65905 - DNA, 18 bp, synthetic construct
  source 1..18: mol_type = other DNA
gcatacgactgaccaaag

SEQ ID NO: 65906 - DNA, 18 bp, synthetic construct
  source 1..18: mol_type = other DNA
gcatacttatctctatag

SEQ ID NO: 65907 - DNA, 18 bp, synthetic construct
  source 1..18: mol_type = other DNA
gcatatgattctctatag

SEQ ID NO: 65908 - DNA, 18 bp, synthetic construct
  source 1..18: mol_type = other DNA
gcatccgactcattaatg

SEQ ID NO: 65909 - DNA, 18 bp, synthetic construct
  source 1..18: mol_type = other DNA
gcattccactcacttttg

SEQ ID NO: 65910 - DNA, 18 bp, synthetic construct
  source 1..18: mol_type = other DNA
ggattcgcttcactttag

SEQ ID NO: 65911 - DNA, 18 bp, synthetic construct
  source 1..18: mol_type = other DNA
gtaacggaatagctattg

SEQ ID NO: 65912 - DNA, 18 bp, synthetic construct
  source 1..18: mol_type = other DNA
gtatacgcctctctttag

SEQ ID NO: 65913 - DNA, 18 bp, synthetic construct
  source 1..18: mol_type = other DNA
gtatacggctcacaaccg

SEQ ID NO: 65914 - DNA, 18 bp, synthetic construct
  source 1..18: mol_type = other DNA
gtatatatctcaccatag

SEQ ID NO: 65915 - DNA, 18 bp, synthetic construct
  source 1..18: mol_type = other DNA
gtatgcgagtcactatgg

SEQ ID NO: 65916 - DNA, 18 bp, synthetic construct
  source 1..18: mol_type = other DNA
gtgtatgatttactttag

SEQ ID NO: 65917 - DNA, 18 bp, synthetic construct
  source 1..18: mol_type = other DNA
gtttacgattccctatag

SEQ ID NO: 65918 - DNA, 18 bp, synthetic construct
  source 1..18: mol_type = other DNA
gtttatgacaggctatag

SEQ ID NO: 65919 - DNA, 18 bp, synthetic construct
  source 1..18: mol_type = other DNA
taaaaacactcacaaaag

SEQ ID NO: 65920 - DNA, 18 bp, synthetic construct
  source 1..18: mol_type = other DNA
taaaaagactctaaatag

SEQ ID NO: 65921 - DNA, 18 bp, synthetic construct
  source 1..18: mol_type = other DNA
taaaaagagaaactagag

SEQ ID NO: 65922 - DNA, 18 bp, synthetic construct
  source 1..18: mol_type = other DNA
taaaaagattcatttaag

SEQ ID NO: 65923 - DNA, 18 bp, synthetic construct
  source 1..18: mol_type = other DNA
taaaaagattctcaatag

SEQ ID NO: 65924 - DNA, 18 bp, synthetic construct
  source 1..18: mol_type = other DNA
taaaaagtcatactttag

SEQ ID NO: 65925 - DNA, 18 bp, synthetic construct
  source 1..18: mol_type = other DNA
taaaacaactcgcttttg

SEQ ID NO: 65926 - DNA, 18 bp, synthetic construct
  source 1..18: mol_type = other DNA
taaaacaacttcccatag

SEQ ID NO: 65927 - DNA, 18 bp, synthetic construct
  source 1..18: mol_type = other DNA
taaaacaacttgctatcg

SEQ ID NO: 65928 - DNA, 18 bp, synthetic construct
  source 1..18: mol_type = other DNA
taaaacagctctcaattg

SEQ ID NO: 65929 - DNA, 18 bp, synthetic construct
  source 1..18: mol_type = other DNA
taaaaccattccttattg

SEQ ID NO: 65930 - DNA, 18 bp, synthetic construct
  source 1..18: mol_type = other DNA
taaaacctatcacattag

SEQ ID NO: 65931 - DNA, 18 bp, synthetic construct
  source 1..18: mol_type = other DNA
taaaacgacatacttaag

SEQ ID NO: 65932 - DNA, 18 bp, synthetic construct
  source 1..18: mol_type = other DNA
taaaacgactcgtaaaag

SEQ ID NO: 65933 - DNA, 18 bp, synthetic construct
  source 1..18: mol_type = other DNA
taaaacgactctacttag

SEQ ID NO: 65934 - DNA, 18 bp, synthetic construct
  source 1..18: mol_type = other DNA
taaaacgcatcattattg

SEQ ID NO: 65935 - DNA, 18 bp, synthetic construct
  source 1..18: mol_type = other DNA
taaaacgcatctctctgg

SEQ ID NO: 65936 - DNA, 18 bp, synthetic construct
  source 1..18: mol_type = other DNA
taaaacgcctcaaggtag

SEQ ID NO: 65937 - DNA, 18 bp, synthetic construct
  source 1..18: mol_type = other DNA
taaaacggttcacaacag

SEQ ID NO: 65938 - DNA, 18 bp, synthetic construct
  source 1..18: mol_type = other DNA
taaaacgtaccaccattg

SEQ ID NO: 65939 - DNA, 18 bp, synthetic construct
  source 1..18: mol_type = other DNA
taaaacgtactactatag

SEQ ID NO: 65940 - DNA, 18 bp, synthetic construct
  source 1..18: mol_type = other DNA
taaaacgtataactagag

SEQ ID NO: 65941 - DNA, 18 bp, synthetic construct
  source 1..18: mol_type = other DNA
taaaacgtcccacattag

SEQ ID NO: 65942 - DNA, 18 bp, synthetic construct
  source 1..18: mol_type = other DNA
taaaacgtccctctaaag

SEQ ID NO: 65943 - DNA, 18 bp, synthetic construct
  source 1..18: mol_type = other DNA
taaaacgtctctttaaag

SEQ ID NO: 65944 - DNA, 18 bp, synthetic construct
  source 1..18: mol_type = other DNA
taaaacgtgtcacaattg

SEQ ID NO: 65945 - DNA, 18 bp, synthetic construct
  source 1..18: mol_type = other DNA
taaaacgtttaacaatag

SEQ ID NO: 65946 - DNA, 18 bp, synthetic construct
  source 1..18: mol_type = other DNA
taaaactcctaaccctag

SEQ ID NO: 65947 - DNA, 18 bp, synthetic construct
  source 1..18: mol_type = other DNA
taaaagcaatcagaatag

SEQ ID NO: 65948 - DNA, 18 bp, synthetic construct
  source 1..18: mol_type = other DNA
taaaaggataaactatcg

SEQ ID NO: 65949 - DNA, 18 bp, synthetic construct
  source 1..18: mol_type = other DNA
taaaagtacttagtgtag

SEQ ID NO: 65950 - DNA, 18 bp, synthetic construct
  source 1..18: mol_type = other DNA
taaaataacacactttag

SEQ ID NO: 65951 - DNA, 18 bp, synthetic construct
  source 1..18: mol_type = other DNA
taaaatcacacaatatag

SEQ ID NO: 65952 - DNA, 18 bp, synthetic construct
  source 1..18: mol_type = other DNA
taaaatctcacacttgag

SEQ ID NO: 65953 - DNA, 18 bp, synthetic construct
  source 1..18: mol_type = other DNA
taaaatgcctctcaatag

SEQ ID NO: 65954 - DNA, 18 bp, synthetic construct
  source 1..18: mol_type = other DNA
taaaatgtcactctatag

SEQ ID NO: 65955 - DNA, 18 bp, synthetic construct
  source 1..18: mol_type = other DNA
taaaccgacatactatcg

SEQ ID NO: 65956 - DNA, 18 bp, synthetic construct
  source 1..18: mol_type = other DNA
taaaccgggtgtccatag

SEQ ID NO: 65957 - DNA, 18 bp, synthetic construct
  source 1..18: mol_type = other DNA
taaaccgtctcacttacg

SEQ ID NO: 65958 - DNA, 18 bp, synthetic construct
  source 1..18: mol_type = other DNA
taaactggctaaccatcg

SEQ ID NO: 65959 - DNA, 18 bp, synthetic construct
  source 1..18: mol_type = other DNA
taaagcaactctataatg

SEQ ID NO: 65960 - DNA, 18 bp, synthetic construct
  source 1..18: mol_type = other DNA
taaagcatcgctctgttg

SEQ ID NO: 65961 - DNA, 18 bp, synthetic construct
  source 1..18: mol_type = other DNA
taaagtgattcccgatag

SEQ ID NO: 65962 - DNA, 18 bp, synthetic construct
  source 1..18: mol_type = other DNA
taaataaactcactattg

SEQ ID NO: 65963 - DNA, 18 bp, synthetic construct
  source 1..18: mol_type = other DNA
taaatagtctcatcatag

SEQ ID NO: 65964 - DNA, 18 bp, synthetic construct
  source 1..18: mol_type = other DNA
taaatcaaattactatag

SEQ ID NO: 65965 - DNA, 18 bp, synthetic construct
  source 1..18: mol_type = other DNA
taaatcaacccactctag

SEQ ID NO: 65966 - DNA, 18 bp, synthetic construct
  source 1..18: mol_type = other DNA
taaatcaactctcaatag

SEQ ID NO: 65967 - DNA, 18 bp, synthetic construct
  source 1..18: mol_type = other DNA
taaatccattcagcctag

SEQ ID NO: 65968 - DNA, 18 bp, synthetic construct
  source 1..18: mol_type = other DNA
taaatcgactcatactag

SEQ ID NO: 65969 - DNA, 18 bp, synthetic construct
  source 1..18: mol_type = other DNA
taaatcgactctcactag

SEQ ID NO: 65970 - DNA, 18 bp, synthetic construct
  source 1..18: mol_type = other DNA
taaatcgatatactgtag

SEQ ID NO: 65971 - DNA, 18 bp, synthetic construct
  source 1..18: mol_type = other DNA
taaatcgattctatatag

SEQ ID NO: 65972 - DNA, 18 bp, synthetic construct
  source 1..18: mol_type = other DNA
taaatcgtctcacaagag

SEQ ID NO: 65973 - DNA, 18 bp, synthetic construct
  source 1..18: mol_type = other DNA
taaatcgtctttcaacag

SEQ ID NO: 65974 - DNA, 18 bp, synthetic construct
  source 1..18: mol_type = other DNA
taaatcttcccaatattg

SEQ ID NO: 65975 - DNA, 18 bp, synthetic construct
  source 1..18: mol_type = other DNA
taaatgaactctttaaag

SEQ ID NO: 65976 - DNA, 18 bp, synthetic construct
  source 1..18: mol_type = other DNA
taaatggactgacttaag

SEQ ID NO: 65977 - DNA, 18 bp, synthetic construct
  source 1..18: mol_type = other DNA
taaattcactgaatatag

SEQ ID NO: 65978 - DNA, 18 bp, synthetic construct
  source 1..18: mol_type = other DNA
taaattgatacactattg

SEQ ID NO: 65979 - DNA, 18 bp, synthetic construct
  source 1..18: mol_type = other DNA
taacaagacactcaagag

SEQ ID NO: 65980 - DNA, 18 bp, synthetic construct
  source 1..18: mol_type = other DNA
taacacaacacactgttg

SEQ ID NO: 65981 - DNA, 18 bp, synthetic construct
  source 1..18: mol_type = other DNA
taacacaactgacaatcg

SEQ ID NO: 65982 - DNA, 18 bp, synthetic construct
  source 1..18: mol_type = other DNA
taacacactacactgtag

SEQ ID NO: 65983 - DNA, 18 bp, synthetic construct
  source 1..18: mol_type = other DNA
taacacacttcaagacag

SEQ ID NO: 65984 - DNA, 18 bp, synthetic construct
  source 1..18: mol_type = other DNA
taacacataacacgatcg

SEQ ID NO: 65985 - DNA, 18 bp, synthetic construct
  source 1..18: mol_type = other DNA
taacacgaccctgtatcg

SEQ ID NO: 65986 - DNA, 18 bp, synthetic construct
  source 1..18: mol_type = other DNA
taacacgactctcttgtg

SEQ ID NO: 65987 - DNA, 18 bp, synthetic construct
  source 1..18: mol_type = other DNA
taacacgataactatttg

SEQ ID NO: 65988 - DNA, 18 bp, synthetic construct
  source 1..18: mol_type = other DNA
taacacgatcctgtatag

SEQ ID NO: 65989 - DNA, 18 bp, synthetic construct
  source 1..18: mol_type = other DNA
taacacgatttgttgtag

SEQ ID NO: 65990 - DNA, 18 bp, synthetic construct
  source 1..18: mol_type = other DNA
taacacggttcacttaag

SEQ ID NO: 65991 - DNA, 18 bp, synthetic construct
  source 1..18: mol_type = other DNA
taacacgtatctctgtag

SEQ ID NO: 65992 - DNA, 18 bp, synthetic construct
  source 1..18: mol_type = other DNA
taacacgtttaactaaag

SEQ ID NO: 65993 - DNA, 18 bp, synthetic construct
  source 1..18: mol_type = other DNA
taacacgtttcaaataag

SEQ ID NO: 65994 - DNA, 18 bp, synthetic construct
  source 1..18: mol_type = other DNA
taacactaaattctatag

SEQ ID NO: 65995 - DNA, 18 bp, synthetic construct
  source 1..18: mol_type = other DNA
taacactacacaatttag

SEQ ID NO: 65996 - DNA, 18 bp, synthetic construct
  source 1..18: mol_type = other DNA
taacactactctgtattg

SEQ ID NO: 65997 - DNA, 18 bp, synthetic construct
  source 1..18: mol_type = other DNA
taacactcataactatag

SEQ ID NO: 65998 - DNA, 18 bp, synthetic construct
  source 1..18: mol_type = other DNA
taacacttctcattatcg

SEQ ID NO: 65999 - DNA, 18 bp, synthetic construct
  source 1..18: mol_type = other DNA
taacatctctcactgtag

SEQ ID NO: 66000 - DNA, 18 bp, synthetic construct
  source 1..18: mol_type = other DNA
taacatgatttcctatcg

SEQ ID NO: 66001 - DNA, 18 bp, synthetic construct
  source 1..18: mol_type = other DNA
taacatgcctcacttaag

SEQ ID NO: 66002 - DNA, 18 bp, synthetic construct
  source 1..18: mol_type = other DNA
taaccaaattcaccacag

SEQ ID NO: 66003 - DNA, 18 bp, synthetic construct
  source 1..18: mol_type = other DNA
taacccgacttataaatg

SEQ ID NO: 66004 - DNA, 18 bp, synthetic construct
  source 1..18: mol_type = other DNA
taacccgattccatattg

SEQ ID NO: 66005 - DNA, 18 bp, synthetic construct
  source 1..18: mol_type = other DNA
taacccttctctttacag

SEQ ID NO: 66006 - DNA, 18 bp, synthetic construct
  source 1..18: mol_type = other DNA
taacctgaccgtccacag

SEQ ID NO: 66007 - DNA, 18 bp, synthetic construct
  source 1..18: mol_type = other DNA
taacgatactcacttttg

SEQ ID NO: 66008 - DNA, 18 bp, synthetic construct
  source 1..18: mol_type = other DNA
taacgatatacactttag

SEQ ID NO: 66009 - DNA, 18 bp, synthetic construct
  source 1..18: mol_type = other DNA
taacgcgagtctctaaag

SEQ ID NO: 66010 - DNA, 18 bp, synthetic construct
  source 1..18: mol_type = other DNA
taactagattcactattg

SEQ ID NO: 66011 - DNA, 18 bp, synthetic construct
  source 1..18: mol_type = other DNA
taactcaacacactgtag

SEQ ID NO: 66012 - DNA, 18 bp, synthetic construct
  source 1..18: mol_type = other DNA
taactcgacacacattag

SEQ ID NO: 66013 - DNA, 18 bp, synthetic construct
  source 1..18: mol_type = other DNA
taactcgactgcccatgg

SEQ ID NO: 66014 - DNA, 18 bp, synthetic construct
  source 1..18: mol_type = other DNA
taactcgacttgaattag

SEQ ID NO: 66015 - DNA, 18 bp, synthetic construct
  source 1..18: mol_type = other DNA
taactcgattcaacatag

SEQ ID NO: 66016 - DNA, 18 bp, synthetic construct
  source 1..18: mol_type = other DNA
taacttaactcacaaatg

SEQ ID NO: 66017 - DNA, 18 bp, synthetic construct
  source 1..18: mol_type = other DNA
taagaagcctccctattg

SEQ ID NO: 66018 - DNA, 18 bp, synthetic construct
  source 1..18: mol_type = other DNA
taagacaacttacaaacg

SEQ ID NO: 66019 - DNA, 18 bp, synthetic construct
  source 1..18: mol_type = other DNA
taagacgaccgtcttttg

SEQ ID NO: 66020 - DNA, 18 bp, synthetic construct
  source 1..18: mol_type = other DNA
taagacgacgctttgtag

SEQ ID NO: 66021 - DNA, 18 bp, synthetic construct
  source 1..18: mol_type = other DNA
taagacgagtctcaattg

SEQ ID NO: 66022 - DNA, 18 bp, synthetic construct
  source 1..18: mol_type = other DNA
taagacggcaagctatag

SEQ ID NO: 66023 - DNA, 18 bp, synthetic construct
  source 1..18: mol_type = other DNA
taagacgtttcaatagag

SEQ ID NO: 66024 - DNA, 18 bp, synthetic construct
  source 1..18: mol_type = other DNA
taagacttcgcactaaag

SEQ ID NO: 66025 - DNA, 18 bp, synthetic construct
  source 1..18: mol_type = other DNA
taagagagcttacattag

SEQ ID NO: 66026 - DNA, 18 bp, synthetic construct
  source 1..18: mol_type = other DNA
taagccgtgtcactataa

SEQ ID NO: 66027 - DNA, 18 bp, synthetic construct
  source 1..18: mol_type = other DNA
taaggcgtcacactgtag

SEQ ID NO: 66028 - DNA, 18 bp, synthetic construct
  source 1..18: mol_type = other DNA
taaggtgtttcactatag

SEQ ID NO: 66029 - DNA, 18 bp, synthetic construct
  source 1..18: mol_type = other DNA
taagtcaactgacgaaag

SEQ ID NO: 66030 - DNA, 18 bp, synthetic construct
  source 1..18: mol_type = other DNA
taagtcgcctcacttttg

SEQ ID NO: 66031 - DNA, 18 bp, synthetic construct
  source 1..18: mol_type = other DNA
taataaaaaagtctatag

SEQ ID NO: 66032 - DNA, 18 bp, synthetic construct
  source 1..18: mol_type = other DNA
taataaaaccgactttag

SEQ ID NO: 66033 - DNA, 18 bp, synthetic construct
  source 1..18: mol_type = other DNA
taataaaactccccatcg

SEQ ID NO: 66034 - DNA, 18 bp, synthetic construct
  source 1..18: mol_type = other DNA
taataaattacactatag

SEQ ID NO: 66035 - DNA, 18 bp, synthetic construct
  source 1..18: mol_type = other DNA
taataacaatcactactg

SEQ ID NO: 66036 - DNA, 18 bp, synthetic construct
  source 1..18: mol_type = other DNA
taataagacacgcaagag

SEQ ID NO: 66037 - DNA, 18 bp, synthetic construct
  source 1..18: mol_type = other DNA
taataagacggagaatag

SEQ ID NO: 66038 - DNA, 18 bp, synthetic construct
  source 1..18: mol_type = other DNA
taataagactctgtccag

SEQ ID NO: 66039 - DNA, 18 bp, synthetic construct
  source 1..18: mol_type = other DNA
taataagactgtgtatcg

SEQ ID NO: 66040 - DNA, 18 bp, synthetic construct
  source 1..18: mol_type = other DNA
taataagagacacaacag

SEQ ID NO: 66041 - DNA, 18 bp, synthetic construct
  source 1..18: mol_type = other DNA
taataagagtcacaaccg

SEQ ID NO: 66042 - DNA, 18 bp, synthetic construct
  source 1..18: mol_type = other DNA
taataagcctcgtattag

SEQ ID NO: 66043 - DNA, 18 bp, synthetic construct
  source 1..18: mol_type = other DNA
taataaggcttacttctg

SEQ ID NO: 66044 - DNA, 18 bp, synthetic construct
  source 1..18: mol_type = other DNA
taataagtcacacattag

SEQ ID NO: 66045 - DNA, 18 bp, synthetic construct
  source 1..18: mol_type = other DNA
taataagtcacatcttag

SEQ ID NO: 66046 - DNA, 18 bp, synthetic construct
  source 1..18: mol_type = other DNA
taataagttatttttttg

SEQ ID NO: 66047 - DNA, 18 bp, synthetic construct
  source 1..18: mol_type = other DNA
taataagtttcacattag

SEQ ID NO: 66048 - DNA, 18 bp, synthetic construct
  source 1..18: mol_type = other DNA
taataagtttcacttttg

SEQ ID NO: 66049 - DNA, 18 bp, synthetic construct
  source 1..18: mol_type = other DNA
taataattctcaatattg

SEQ ID NO: 66050 - DNA, 18 bp, synthetic construct
  source 1..18: mol_type = other DNA
taatacaaaacacgagcg

SEQ ID NO: 66051 - DNA, 18 bp, synthetic construct
  source 1..18: mol_type = other DNA
taatacaacttccttgag

SEQ ID NO: 66052 - DNA, 18 bp, synthetic construct
  source 1..18: mol_type = other DNA
taatacaagaccccatcg

SEQ ID NO: 66053 - DNA, 18 bp, synthetic construct
  source 1..18: mol_type = other DNA
taatacacaccgcattag

SEQ ID NO: 66054 - DNA, 18 bp, synthetic construct
  source 1..18: mol_type = other DNA
taatacactccacttgcg

SEQ ID NO: 66055 - DNA, 18 bp, synthetic construct
  source 1..18: mol_type = other DNA
taatacatctaaatacag

SEQ ID NO: 66056 - DNA, 18 bp, synthetic construct
  source 1..18: mol_type = other DNA
taatacatctctcgatgg

SEQ ID NO: 66057 - DNA, 18 bp, synthetic construct
  source 1..18: mol_type = other DNA
taatacatgtaactaaag

SEQ ID NO: 66058 - DNA, 18 bp, synthetic construct
  source 1..18: mol_type = other DNA
taataccaactacaatag

SEQ ID NO: 66059 - DNA, 18 bp, synthetic construct
  source 1..18: mol_type = other DNA
taataccactcaacaatg

SEQ ID NO: 66060 - DNA, 18 bp, synthetic construct
  source 1..18: mol_type = other DNA
taataccactctataatg

SEQ ID NO: 66061 - DNA, 18 bp, synthetic construct
  source 1..18: mol_type = other DNA
taataccagtctacttag

SEQ ID NO: 66062 - DNA, 18 bp, synthetic construct
  source 1..18: mol_type = other DNA
taataccagtttttatcg

SEQ ID NO: 66063 - DNA, 18 bp, synthetic construct
  source 1..18: mol_type = other DNA
taataccatacacaaaag

SEQ ID NO: 66064 - DNA, 18 bp, synthetic construct
  source 1..18: mol_type = other DNA
taataccatacattaaag

SEQ ID NO: 66065 - DNA, 18 bp, synthetic construct
  source 1..18: mol_type = other DNA
taataccattttcaatag

SEQ ID NO: 66066 - DNA, 18 bp, synthetic construct
  source 1..18: mol_type = other DNA
taatacccctcataagcg

SEQ ID NO: 66067 - DNA, 18 bp, synthetic construct
  source 1..18: mol_type = other DNA
taataccctgcactcttg

SEQ ID NO: 66068 - DNA, 18 bp, synthetic construct
  source 1..18: mol_type = other DNA
taatacctctcaatagcg

SEQ ID NO: 66069 - DNA, 18 bp, synthetic construct
  source 1..18: mol_type = other DNA
taatacctctcacataag

SEQ ID NO: 66070 - DNA, 18 bp, synthetic construct
  source 1..18: mol_type = other DNA
taatacctttaatcatag

SEQ ID NO: 66071 - DNA, 18 bp, synthetic construct
  source 1..18: mol_type = other DNA
taatacgacactaaattg

SEQ ID NO: 66072 - DNA, 18 bp, synthetic construct
  source 1..18: mol_type = other DNA
taatacgacactcatcag

SEQ ID NO: 66073 - DNA, 18 bp, synthetic construct
  source 1..18: mol_type = other DNA
taatacgactccattagg

SEQ ID NO: 66074 - DNA, 18 bp, synthetic construct
  source 1..18: mol_type = other DNA
taatacgactccattatg

SEQ ID NO: 66075 - DNA, 18 bp, synthetic construct
  source 1..18: mol_type = other DNA
taatacgactccgatttg

SEQ ID NO: 66076 - DNA, 18 bp, synthetic construct
  source 1..18: mol_type = other DNA
taatacgactcttttatg

SEQ ID NO: 66077 - DNA, 18 bp, synthetic construct
  source 1..18: mol_type = other DNA
taatacgagtgatttttg

SEQ ID NO: 66078 - DNA, 18 bp, synthetic construct
  source 1..18: mol_type = other DNA
taatacgcatgacaatgg

SEQ ID NO: 66079 - DNA, 18 bp, synthetic construct
  source 1..18: mol_type = other DNA
taatacgcatttcaatag

SEQ ID NO: 66080 - DNA, 18 bp, synthetic construct
  source 1..18: mol_type = other DNA
taatacgcccctccattg

SEQ ID NO: 66081 - DNA, 18 bp, synthetic construct
  source 1..18: mol_type = other DNA
taatacgcgaaacaagag

SEQ ID NO: 66082 - DNA, 18 bp, synthetic construct
  source 1..18: mol_type = other DNA
taatacgcttcttaatag

SEQ ID NO: 66083 - DNA, 18 bp, synthetic construct
  source 1..18: mol_type = other DNA
taatacggctagccatcg

SEQ ID NO: 66084 - DNA, 18 bp, synthetic construct
  source 1..18: mol_type = other DNA
taatacgtactactccag

SEQ ID NO: 66085 - DNA, 18 bp, synthetic construct
  source 1..18: mol_type = other DNA
taatacgtatctccaaag

SEQ ID NO: 66086 - DNA, 18 bp, synthetic construct
  source 1..18: mol_type = other DNA
taatacgtatgaccattg

SEQ ID NO: 66087 - DNA, 18 bp, synthetic construct
  source 1..18: mol_type = other DNA
taatacgtcaatctaaag

SEQ ID NO: 66088 - DNA, 18 bp, synthetic construct
  source 1..18: mol_type = other DNA
taatacgtcactctaatg

SEQ ID NO: 66089 - DNA, 18 bp, synthetic construct
  source 1..18: mol_type = other DNA
taatacgtccgatttggg

SEQ ID NO: 66090 - DNA, 18 bp, synthetic construct
  source 1..18: mol_type = other DNA
taatacgtccgtttttag

SEQ ID NO: 66091 - DNA, 18 bp, synthetic construct
  source 1..18: mol_type = other DNA
taatacgtcgcggaatag

SEQ ID NO: 66092 - DNA, 18 bp, synthetic construct
  source 1..18: mol_type = other DNA
taatacgtctaacttatg

SEQ ID NO: 66093 - DNA, 18 bp, synthetic construct
  source 1..18: mol_type = other DNA
taatacgtctcatttatg

SEQ ID NO: 66094 - DNA, 18 bp, synthetic construct
  source 1..18: mol_type = other DNA
taatacgtctttcaaatg

SEQ ID NO: 66095 - DNA, 18 bp, synthetic construct
  source 1..18: mol_type = other DNA
taatacgtgcaattctag

SEQ ID NO: 66096 - DNA, 18 bp, synthetic construct
  source 1..18: mol_type = other DNA
taatacgtttcactcatg

SEQ ID NO: 66097 - DNA, 18 bp, synthetic construct
  source 1..18: mol_type = other DNA
taatactaatcgcaattg

SEQ ID NO: 66098 - DNA, 18 bp, synthetic construct
  source 1..18: mol_type = other DNA
taatactacgtaatacag

SEQ ID NO: 66099 - DNA, 18 bp, synthetic construct
  source 1..18: mol_type = other DNA
taatactacttatatacg

SEQ ID NO: 66100 - DNA, 18 bp, synthetic construct
  source 1..18: mol_type = other DNA
taatactagtcaccactg

SEQ ID NO: 66101 - DNA, 18 bp, synthetic construct
  source 1..18: mol_type = other DNA
taatactattctatattg

SEQ ID NO: 66102 - DNA, 18 bp, synthetic construct
  source 1..18: mol_type = other DNA
taatactcctcatcatgg

SEQ ID NO: 66103 - DNA, 18 bp, synthetic construct
  source 1..18: mol_type = other DNA
taatactcctctacaaag

SEQ ID NO: 66104 - DNA, 18 bp, synthetic construct
  source 1..18: mol_type = other DNA
taatactccttcctaaag

SEQ ID NO: 66105 - DNA, 18 bp, synthetic construct
  source 1..18: mol_type = other DNA
taatactcgtctatattg

SEQ ID NO: 66106 - DNA, 18 bp, synthetic construct
  source 1..18: mol_type = other DNA
taatactcttcgctgtag

SEQ ID NO: 66107 - DNA, 18 bp, synthetic construct
  source 1..18: mol_type = other DNA
taatactgctcatcatcg

SEQ ID NO: 66108 - DNA, 18 bp, synthetic construct
  source 1..18: mol_type = other DNA
taatactgcttcctgtag

SEQ ID NO: 66109 - DNA, 18 bp, synthetic construct
  source 1..18: mol_type = other DNA
taatactggtcagtctag

SEQ ID NO: 66110 - DNA, 18 bp, synthetic construct
  source 1..18: mol_type = other DNA
taatacttcctactctag

SEQ ID NO: 66111 - DNA, 18 bp, synthetic construct
  source 1..18: mol_type = other DNA
taatacttctccttattg

SEQ ID NO: 66112 - DNA, 18 bp, synthetic construct
  source 1..18: mol_type = other DNA
taatacttgacatataag

SEQ ID NO: 66113 - DNA, 18 bp, synthetic construct
  source 1..18: mol_type = other DNA
taatacttgacattatag

SEQ ID NO: 66114 - DNA, 18 bp, synthetic construct
  source 1..18: mol_type = other DNA
taatacttggcaatctag

SEQ ID NO: 66115 - DNA, 18 bp, synthetic construct
  source 1..18: mol_type = other DNA
taatagaactcaatcaag

SEQ ID NO: 66116 - DNA, 18 bp, synthetic construct
  source 1..18: mol_type = other DNA
taatagagctcacaacag

SEQ ID NO: 66117 - DNA, 18 bp, synthetic construct
  source 1..18: mol_type = other DNA
taatagcacccactaatg

SEQ ID NO: 66118 - DNA, 18 bp, synthetic construct
  source 1..18: mol_type = other DNA
taataggaatcaattttg

SEQ ID NO: 66119 - DNA, 18 bp, synthetic construct
  source 1..18: mol_type = other DNA
taataggacacacagtcg

SEQ ID NO: 66120 - DNA, 18 bp, synthetic construct
  source 1..18: mol_type = other DNA
taataggacttttgaatg

SEQ ID NO: 66121 - DNA, 18 bp, synthetic construct
  source 1..18: mol_type = other DNA
taataggtcttacactag

SEQ ID NO: 66122 - DNA, 18 bp, synthetic construct
  source 1..18: mol_type = other DNA
taatataacacaatgtag

SEQ ID NO: 66123 - DNA, 18 bp, synthetic construct
  source 1..18: mol_type = other DNA
taatataacacactagcg

SEQ ID NO: 66124 - DNA, 18 bp, synthetic construct
  source 1..18: mol_type = other DNA
taatataccactttttag

SEQ ID NO: 66125 - DNA, 18 bp, synthetic construct
  source 1..18: mol_type = other DNA
taatatatttcaccatgg

SEQ ID NO: 66126 - DNA, 18 bp, synthetic construct
  source 1..18: mol_type = other DNA
taatatatttcattatag

SEQ ID NO: 66127 - DNA, 18 bp, synthetic construct
  source 1..18: mol_type = other DNA
taatatcaatcactgtgg

SEQ ID NO: 66128 - DNA, 18 bp, synthetic construct
  source 1..18: mol_type = other DNA
taatatctcacaatatag

SEQ ID NO: 66129 - DNA, 18 bp, synthetic construct
  source 1..18: mol_type = other DNA
taatatctctctcaatag

SEQ ID NO: 66130 - DNA, 18 bp, synthetic construct
  source 1..18: mol_type = other DNA
taatatgacaaccataag

SEQ ID NO: 66131 - DNA, 18 bp, synthetic construct
  source 1..18: mol_type = other DNA
taatatgacactccttcg

SEQ ID NO: 66132 - DNA, 18 bp, synthetic construct
  source 1..18: mol_type = other DNA
taatatgacatacaaaag

SEQ ID NO: 66133 - DNA, 18 bp, synthetic construct
  source 1..18: mol_type = other DNA
taatatgacatacaagtg

SEQ ID NO: 66134 - DNA, 18 bp, synthetic construct
  source 1..18: mol_type = other DNA
taatatgacccattgtcg

SEQ ID NO: 66135 - DNA, 18 bp, synthetic construct
  source 1..18: mol_type = other DNA
taatatgactaattaatg

SEQ ID NO: 66136 - DNA, 18 bp, synthetic construct
  source 1..18: mol_type = other DNA
taatatgactggcgaaag

SEQ ID NO: 66137 - DNA, 18 bp, synthetic construct
  source 1..18: mol_type = other DNA
taatatgagtttttactg

SEQ ID NO: 66138 - DNA, 18 bp, synthetic construct
  source 1..18: mol_type = other DNA
taatatgatacatactcg

SEQ ID NO: 66139 - DNA, 18 bp, synthetic construct
  source 1..18: mol_type = other DNA
taatatgattccacctag

SEQ ID NO: 66140 - DNA, 18 bp, synthetic construct
  source 1..18: mol_type = other DNA
taatatgccacccaatag

SEQ ID NO: 66141 - DNA, 18 bp, synthetic construct
  source 1..18: mol_type = other DNA
taatatggattactgtag

SEQ ID NO: 66142 - DNA, 18 bp, synthetic construct
  source 1..18: mol_type = other DNA
taatatgtataactaaag

SEQ ID NO: 66143 - DNA, 18 bp, synthetic construct
  source 1..18: mol_type = other DNA
taatatgtctcaatttgg

SEQ ID NO: 66144 - DNA, 18 bp, synthetic construct
  source 1..18: mol_type = other DNA
taatatgtgtccctacag

SEQ ID NO: 66145 - DNA, 18 bp, synthetic construct
  source 1..18: mol_type = other DNA
taatatgtttcccatatg

SEQ ID NO: 66146 - DNA, 18 bp, synthetic construct
  source 1..18: mol_type = other DNA
taatattacactatattg

SEQ ID NO: 66147 - DNA, 18 bp, synthetic construct
  source 1..18: mol_type = other DNA
taatattacatactgttg

SEQ ID NO: 66148 - DNA, 18 bp, synthetic construct
  source 1..18: mol_type = other DNA
taatattactctctgatg

SEQ ID NO: 66149 - DNA, 18 bp, synthetic construct
  source 1..18: mol_type = other DNA
taatattgctgacttaag

SEQ ID NO: 66150 - DNA, 18 bp, synthetic construct
  source 1..18: mol_type = other DNA
taatatttcacgatatag

SEQ ID NO: 66151 - DNA, 18 bp, synthetic construct
  source 1..18: mol_type = other DNA
taatccaaatcactacgg

SEQ ID NO: 66152 - DNA, 18 bp, synthetic construct
  source 1..18: mol_type = other DNA
taatccaatacaatatag

SEQ ID NO: 66153 - DNA, 18 bp, synthetic construct
  source 1..18: mol_type = other DNA
taatccacctcaatattg

SEQ ID NO: 66154 - DNA, 18 bp, synthetic construct
  source 1..18: mol_type = other DNA
taatcccaattactacag

SEQ ID NO: 66155 - DNA, 18 bp, synthetic construct
  source 1..18: mol_type = other DNA
taatcccatacaccattg

SEQ ID NO: 66156 - DNA, 18 bp, synthetic construct
  source 1..18: mol_type = other DNA
taatccccctcacttttg

SEQ ID NO: 66157 - DNA, 18 bp, synthetic construct
  source 1..18: mol_type = other DNA
taatcccgtactctatcg

SEQ ID NO: 66158 - DNA, 18 bp, synthetic construct
  source 1..18: mol_type = other DNA
taatccgaaaagctatag

SEQ ID NO: 66159 - DNA, 18 bp, synthetic construct
  source 1..18: mol_type = other DNA
taatccgattaacttttg

SEQ ID NO: 66160 - DNA, 18 bp, synthetic construct
  source 1..18: mol_type = other DNA
taatccgtgtatctatag

SEQ ID NO: 66161 - DNA, 18 bp, synthetic construct
  source 1..18: mol_type = other DNA
taatcctactcaccaacg

SEQ ID NO: 66162 - DNA, 18 bp, synthetic construct
  source 1..18: mol_type = other DNA
taatccttttcgctttag

SEQ ID NO: 66163 - DNA, 18 bp, synthetic construct
  source 1..18: mol_type = other DNA
taatcgatttcactgtag

SEQ ID NO: 66164 - DNA, 18 bp, synthetic construct
  source 1..18: mol_type = other DNA
taatcggacaaacttatg

SEQ ID NO: 66165 - DNA, 18 bp, synthetic construct
  source 1..18: mol_type = other DNA
taatcggactcacaaacg

SEQ ID NO: 66166 - DNA, 18 bp, synthetic construct
  source 1..18: mol_type = other DNA
taatcggccacgttatag

SEQ ID NO: 66167 - DNA, 18 bp, synthetic construct
  source 1..18: mol_type = other DNA
taatctaacacagtatag

SEQ ID NO: 66168 - DNA, 18 bp, synthetic construct
  source 1..18: mol_type = other DNA
taatctatcgcactttag

SEQ ID NO: 66169 - DNA, 18 bp, synthetic construct
  source 1..18: mol_type = other DNA
taatctgaaccgctatag

SEQ ID NO: 66170 - DNA, 18 bp, synthetic construct
  source 1..18: mol_type = other DNA
taatctgtcccattgtag

SEQ ID NO: 66171 - DNA, 18 bp, synthetic construct
  source 1..18: mol_type = other DNA
taatcttattcactcaag

SEQ ID NO: 66172 - DNA, 18 bp, synthetic construct
  source 1..18: mol_type = other DNA
taatgagactctcaatcg

SEQ ID NO: 66173 - DNA, 18 bp, synthetic construct
  source 1..18: mol_type = other DNA
taatgagtcattctatag

SEQ ID NO: 66174 - DNA, 18 bp, synthetic construct
  source 1..18: mol_type = other DNA
taatgcacttttctatag

SEQ ID NO: 66175 - DNA, 18 bp, synthetic construct
  source 1..18: mol_type = other DNA
taatgcagctctttatag

SEQ ID NO: 66176 - DNA, 18 bp, synthetic construct
  source 1..18: mol_type = other DNA
taatgcatttcgcaatag

SEQ ID NO: 66177 - DNA, 18 bp, synthetic construct
  source 1..18: mol_type = other DNA
taatgcgacatacttaag

SEQ ID NO: 66178 - DNA, 18 bp, synthetic construct
  source 1..18: mol_type = other DNA
taatgcgattttctattg

SEQ ID NO: 66179 - DNA, 18 bp, synthetic construct
  source 1..18: mol_type = other DNA
taatgcgcatctttatag

SEQ ID NO: 66180 - DNA, 18 bp, synthetic construct
  source 1..18: mol_type = other DNA
taatgcgcctcaacttag

SEQ ID NO: 66181 - DNA, 18 bp, synthetic construct
  source 1..18: mol_type = other DNA
taatgctattaacaatag

SEQ ID NO: 66182 - DNA, 18 bp, synthetic construct
  source 1..18: mol_type = other DNA
taatggcaacaactaaag

SEQ ID NO: 66183 - DNA, 18 bp, synthetic construct
  source 1..18: mol_type = other DNA
taatgtgacttaccatgg

SEQ ID NO: 66184 - DNA, 18 bp, synthetic construct
  source 1..18: mol_type = other DNA
taattaatcacactattg

SEQ ID NO: 66185 - DNA, 18 bp, synthetic construct
  source 1..18: mol_type = other DNA
taattaatttcactatag

SEQ ID NO: 66186 - DNA, 18 bp, synthetic construct
  source 1..18: mol_type = other DNA
taattacactcacttcag

SEQ ID NO: 66187 - DNA, 18 bp, synthetic construct
  source 1..18: mol_type = other DNA
taattacactcgcttaag

SEQ ID NO: 66188 - DNA, 18 bp, synthetic construct
  source 1..18: mol_type = other DNA
taattagaaactctatag

SEQ ID NO: 66189 - DNA, 18 bp, synthetic construct
  source 1..18: mol_type = other DNA
taattagacaaactattg

SEQ ID NO: 66190 - DNA, 18 bp, synthetic construct
  source 1..18: mol_type = other DNA
taattagactcacttgtg

SEQ ID NO: 66191 - DNA, 18 bp, synthetic construct
  source 1..18: mol_type = other DNA
taattatactcacattag

SEQ ID NO: 66192 - DNA, 18 bp, synthetic construct
  source 1..18: mol_type = other DNA
taattattctcacaattg

SEQ ID NO: 66193 - DNA, 18 bp, synthetic construct
  source 1..18: mol_type = other DNA
taattcaactcattttcg

SEQ ID NO: 66194 - DNA, 18 bp, synthetic construct
  source 1..18: mol_type = other DNA
taattcaactgacaattg

SEQ ID NO: 66195 - DNA, 18 bp, synthetic construct
  source 1..18: mol_type = other DNA
taattcaattcacaaatg

SEQ ID NO: 66196 - DNA, 18 bp, synthetic construct
  source 1..18: mol_type = other DNA
taattcaccagactatag

SEQ ID NO: 66197 - DNA, 18 bp, synthetic construct
  source 1..18: mol_type = other DNA
taattcatattactattg

SEQ ID NO: 66198 - DNA, 18 bp, synthetic construct
  source 1..18: mol_type = other DNA
taattccaataactctag

SEQ ID NO: 66199 - DNA, 18 bp, synthetic construct
  source 1..18: mol_type = other DNA
taattccaatgaatatag

SEQ ID NO: 66200 - DNA, 18 bp, synthetic construct
  source 1..18: mol_type = other DNA
taattccactcacatttg

SEQ ID NO: 66201 - DNA, 18 bp, synthetic construct
  source 1..18: mol_type = other DNA
taattccactcattctcg

SEQ ID NO: 66202 - DNA, 18 bp, synthetic construct
  source 1..18: mol_type = other DNA
taattcctctcacttatg

SEQ ID NO: 66203 - DNA, 18 bp, synthetic construct
  source 1..18: mol_type = other DNA
taattcctctgaccatag

SEQ ID NO: 66204 - DNA, 18 bp, synthetic construct
  source 1..18: mol_type = other DNA
taattcgaatccctaacg

SEQ ID NO: 66205 - DNA, 18 bp, synthetic construct
  source 1..18: mol_type = other DNA
taattcgacaagctatgg

SEQ ID NO: 66206 - DNA, 18 bp, synthetic construct
  source 1..18: mol_type = other DNA
taattcgacattcaaaag

SEQ ID NO: 66207 - DNA, 18 bp, synthetic construct
  source 1..18: mol_type = other DNA
taattcgacccacagaag

SEQ ID NO: 66208 - DNA, 18 bp, synthetic construct
  source 1..18: mol_type = other DNA
taattcgactcccctttg

SEQ ID NO: 66209 - DNA, 18 bp, synthetic construct
  source 1..18: mol_type = other DNA
taattcgactcgcaaacg

SEQ ID NO: 66210 - DNA, 18 bp, synthetic construct
  source 1..18: mol_type = other DNA
taattcgactctaatttg

SEQ ID NO: 66211 - DNA, 18 bp, synthetic construct
  source 1..18: mol_type = other DNA
taattcgactgaaaattg

SEQ ID NO: 66212 - DNA, 18 bp, synthetic construct
  source 1..18: mol_type = other DNA
taattcgactgattttcg

SEQ ID NO: 66213 - DNA, 18 bp, synthetic construct
  source 1..18: mol_type = other DNA
taattcgatcctatttag

SEQ ID NO: 66214 - DNA, 18 bp, synthetic construct
  source 1..18: mol_type = other DNA
taattcgattaaatgtag

SEQ ID NO: 66215 - DNA, 18 bp, synthetic construct
  source 1..18: mol_type = other DNA
taattcgattaattctag

SEQ ID NO: 66216 - DNA, 18 bp, synthetic construct
  source 1..18: mol_type = other DNA
taattcgccacacattag

SEQ ID NO: 66217 - DNA, 18 bp, synthetic construct
  source 1..18: mol_type = other DNA
taattcgccatactaaag

SEQ ID NO: 66218 - DNA, 18 bp, synthetic construct
  source 1..18: mol_type = other DNA
taattcgtccccccatag

SEQ ID NO: 66219 - DNA, 18 bp, synthetic construct
  source 1..18: mol_type = other DNA
taattcgtcgcactgaag

SEQ ID NO: 66220 - DNA, 18 bp, synthetic construct
  source 1..18: mol_type = other DNA
taattcgtgttacaatag

SEQ ID NO: 66221 - DNA, 18 bp, synthetic construct
  source 1..18: mol_type = other DNA
taattcgtttcacagtag

SEQ ID NO: 66222 - DNA, 18 bp, synthetic construct
  source 1..18: mol_type = other DNA
taattctacacacttaag

SEQ ID NO: 66223 - DNA, 18 bp, synthetic construct
  source 1..18: mol_type = other DNA
taattctactctcctaag

SEQ ID NO: 66224 - DNA, 18 bp, synthetic construct
  source 1..18: mol_type = other DNA
taattctagtccctctag

SEQ ID NO: 66225 - DNA, 18 bp, synthetic construct
  source 1..18: mol_type = other DNA
taattcttcacactacag

SEQ ID NO: 66226 - DNA, 18 bp, synthetic construct
  source 1..18: mol_type = other DNA
taattcttctcaatattg

SEQ ID NO: 66227 - DNA, 18 bp, synthetic construct
  source 1..18: mol_type = other DNA
taattcttctcaccttag

SEQ ID NO: 66228 - DNA, 18 bp, synthetic construct
  source 1..18: mol_type = other DNA
taattgcacttacaatag

SEQ ID NO: 66229 - DNA, 18 bp, synthetic construct
  source 1..18: mol_type = other DNA
taattggactcacctaag

SEQ ID NO: 66230 - DNA, 18 bp, synthetic construct
  source 1..18: mol_type = other DNA
taatttaaatgacttctg

SEQ ID NO: 66231 - DNA, 18 bp, synthetic construct
  source 1..18: mol_type = other DNA
taatttaactccttatag

SEQ ID NO: 66232 - DNA, 18 bp, synthetic construct
  source 1..18: mol_type = other DNA
taatttatctcacgattg

SEQ ID NO: 66233 - DNA, 18 bp, synthetic construct
  source 1..18: mol_type = other DNA
taatttctctcaatatag

SEQ ID NO: 66234 - DNA, 18 bp, synthetic construct
  source 1..18: mol_type = other DNA
taatttgaatcagtctag

SEQ ID NO: 66235 - DNA, 18 bp, synthetic construct
  source 1..18: mol_type = other DNA
taatttgactcccttttg

SEQ ID NO: 66236 - DNA, 18 bp, synthetic construct
  source 1..18: mol_type = other DNA
taatttgcctcacaatgg

SEQ ID NO: 66237 - DNA, 18 bp, synthetic construct
  source 1..18: mol_type = other DNA
taattttactaactattg

SEQ ID NO: 66238 - DNA, 18 bp, synthetic construct
  source 1..18: mol_type = other DNA
taattttcctcacttaag

SEQ ID NO: 66239 - DNA, 18 bp, synthetic construct
  source 1..18: mol_type = other DNA
taatttttcacactatag

SEQ ID NO: 66240 - DNA, 18 bp, synthetic construct
  source 1..18: mol_type = other DNA
tacaaagattcacttacg

SEQ ID NO: 66241 - DNA, 18 bp, synthetic construct
  source 1..18: mol_type = other DNA
tacaaagtctccctaaag

SEQ ID NO: 66242 - DNA, 18 bp, synthetic construct
  source 1..18: mol_type = other DNA
tacaaccacacgctatag

SEQ ID NO: 66243 - DNA, 18 bp, synthetic construct
  source 1..18: mol_type = other DNA
tacaacgactcatattag

SEQ ID NO: 66244 - DNA, 18 bp, synthetic construct
  source 1..18: mol_type = other DNA
tacaacgactctgcatag

SEQ ID NO: 66245 - DNA, 18 bp, synthetic construct
  source 1..18: mol_type = other DNA
tacaacgattcaatattg

SEQ ID NO: 66246 - DNA, 18 bp, synthetic construct
  source 1..18: mol_type = other DNA
tacaacgattcattattg

SEQ ID NO: 66247 - DNA, 18 bp, synthetic construct
  source 1..18: mol_type = other DNA
tacaccgacccactaatg

SEQ ID NO: 66248 - DNA, 18 bp, synthetic construct
  source 1..18: mol_type = other DNA
tacatcggctcaccattg

SEQ ID NO: 66249 - DNA, 18 bp, synthetic construct
  source 1..18: mol_type = other DNA
tacatggaattacttaag

SEQ ID NO: 66250 - DNA, 18 bp, synthetic construct
  source 1..18: mol_type = other DNA
taccacaactcaattaag

SEQ ID NO: 66251 - DNA, 18 bp, synthetic construct
  source 1..18: mol_type = other DNA
taccacgactcacacaag

SEQ ID NO: 66252 - DNA, 18 bp, synthetic construct
  source 1..18: mol_type = other DNA
taccacgacttattgtag

SEQ ID NO: 66253 - DNA, 18 bp, synthetic construct
  source 1..18: mol_type = other DNA
taccacggatatgttttg

SEQ ID NO: 66254 - DNA, 18 bp, synthetic construct
  source 1..18: mol_type = other DNA
taccacggatcactaaag

SEQ ID NO: 66255 - DNA, 18 bp, synthetic construct
  source 1..18: mol_type = other DNA
taccacgtatcactttag

SEQ ID NO: 66256 - DNA, 18 bp, synthetic construct
  source 1..18: mol_type = other DNA
taccacgtttccctatag

SEQ ID NO: 66257 - DNA, 18 bp, synthetic construct
  source 1..18: mol_type = other DNA
tactaaaagtcacaaaag

SEQ ID NO: 66258 - DNA, 18 bp, synthetic construct
  source 1..18: mol_type = other DNA
tactaaatatcgctattg

SEQ ID NO: 66259 - DNA, 18 bp, synthetic construct
  source 1..18: mol_type = other DNA
tactaagattcacttcag

SEQ ID NO: 66260 - DNA, 18 bp, synthetic construct
  source 1..18: mol_type = other DNA
tactaagtctccttacag

SEQ ID NO: 66261 - DNA, 18 bp, synthetic construct
  source 1..18: mol_type = other DNA
tactaattctctccatag

SEQ ID NO: 66262 - DNA, 18 bp, synthetic construct
  source 1..18: mol_type = other DNA
tactacaaaccacttatg

SEQ ID NO: 66263 - DNA, 18 bp, synthetic construct
  source 1..18: mol_type = other DNA
tactacacctggctctag

SEQ ID NO: 66264 - DNA, 18 bp, synthetic construct
  source 1..18: mol_type = other DNA
tactaccacacaccttgg

SEQ ID NO: 66265 - DNA, 18 bp, synthetic construct
  source 1..18: mol_type = other DNA
tactacgacactcatttg

SEQ ID NO: 66266 - DNA, 18 bp, synthetic construct
  source 1..18: mol_type = other DNA
tactacgacataatttag

SEQ ID NO: 66267 - DNA, 18 bp, synthetic construct
  source 1..18: mol_type = other DNA
tactacgactttcaaaag

SEQ ID NO: 66268 - DNA, 18 bp, synthetic construct
  source 1..18: mol_type = other DNA
tactacgatttgcactag

SEQ ID NO: 66269 - DNA, 18 bp, synthetic construct
  source 1..18: mol_type = other DNA
tactacgcaccattttag

SEQ ID NO: 66270 - DNA, 18 bp, synthetic construct
  source 1..18: mol_type = other DNA
tactacggcacaatacag

SEQ ID NO: 66271 - DNA, 18 bp, synthetic construct
  source 1..18: mol_type = other DNA
tactacgtcacaccttag

SEQ ID NO: 66272 - DNA, 18 bp, synthetic construct
  source 1..18: mol_type = other DNA
tactacgtctctttttag

SEQ ID NO: 66273 - DNA, 18 bp, synthetic construct
  source 1..18: mol_type = other DNA
tactactactcttagtgg

SEQ ID NO: 66274 - DNA, 18 bp, synthetic construct
  source 1..18: mol_type = other DNA
tactactattcacaaaag

SEQ ID NO: 66275 - DNA, 18 bp, synthetic construct
  source 1..18: mol_type = other DNA
tactactgctccttactg

SEQ ID NO: 66276 - DNA, 18 bp, synthetic construct
  source 1..18: mol_type = other DNA
tactacttttcacccttg

SEQ ID NO: 66277 - DNA, 18 bp, synthetic construct
  source 1..18: mol_type = other DNA
tactagaactctctttag

SEQ ID NO: 66278 - DNA, 18 bp, synthetic construct
  source 1..18: mol_type = other DNA
tactagatgtcactatag

SEQ ID NO: 66279 - DNA, 18 bp, synthetic construct
  source 1..18: mol_type = other DNA
tactaggactcccaaaag

SEQ ID NO: 66280 - DNA, 18 bp, synthetic construct
  source 1..18: mol_type = other DNA
tactataagtcactgttg

SEQ ID NO: 66281 - DNA, 18 bp, synthetic construct
  source 1..18: mol_type = other DNA
tactatgaccaattttag

SEQ ID NO: 66282 - DNA, 18 bp, synthetic construct
  source 1..18: mol_type = other DNA
tactatgattcacgaaag

SEQ ID NO: 66283 - DNA, 18 bp, synthetic construct
  source 1..18: mol_type = other DNA
tactatgattctctattg

SEQ ID NO: 66284 - DNA, 18 bp, synthetic construct
  source 1..18: mol_type = other DNA
tactatgtctctgtatag

SEQ ID NO: 66285 - DNA, 18 bp, synthetic construct
  source 1..18: mol_type = other DNA
tactccgacaaactacag

SEQ ID NO: 66286 - DNA, 18 bp, synthetic construct
  source 1..18: mol_type = other DNA
tactccgacactctaatg

SEQ ID NO: 66287 - DNA, 18 bp, synthetic construct
  source 1..18: mol_type = other DNA
tactccggcttactttag

SEQ ID NO: 66288 - DNA, 18 bp, synthetic construct
  source 1..18: mol_type = other DNA
tactccgttcgacaaaag

SEQ ID NO: 66289 - DNA, 18 bp, synthetic construct
  source 1..18: mol_type = other DNA
tactcttcctcagtatag

SEQ ID NO: 66290 - DNA, 18 bp, synthetic construct
  source 1..18: mol_type = other DNA
tactgcccttcattttgg

SEQ ID NO: 66291 - DNA, 18 bp, synthetic construct
  source 1..18: mol_type = other DNA
tactgcgactcaccaacg

SEQ ID NO: 66292 - DNA, 18 bp, synthetic construct
  source 1..18: mol_type = other DNA
tactgcgattccctatgg

SEQ ID NO: 66293 - DNA, 18 bp, synthetic construct
  source 1..18: mol_type = other DNA
tactgcttttcacaaaag

SEQ ID NO: 66294 - DNA, 18 bp, synthetic construct
  source 1..18: mol_type = other DNA
tacttcaactggctattg

SEQ ID NO: 66295 - DNA, 18 bp, synthetic construct
  source 1..18: mol_type = other DNA
tacttcatctatccattg

SEQ ID NO: 66296 - DNA, 18 bp, synthetic construct
  source 1..18: mol_type = other DNA
tacttcgacacacaaatg

SEQ ID NO: 66297 - DNA, 18 bp, synthetic construct
  source 1..18: mol_type = other DNA
tacttcgactaatgatag

SEQ ID NO: 66298 - DNA, 18 bp, synthetic construct
  source 1..18: mol_type = other DNA
tacttcgagtcgcaatcg

SEQ ID NO: 66299 - DNA, 18 bp, synthetic construct
  source 1..18: mol_type = other DNA
tagaaccacacataaaag

SEQ ID NO: 66300 - DNA, 18 bp, synthetic construct
  source 1..18: mol_type = other DNA
tagaacgactcacaaccg

SEQ ID NO: 66301 - DNA, 18 bp, synthetic construct
  source 1..18: mol_type = other DNA
tagaccaacttactatag

SEQ ID NO: 66302 - DNA, 18 bp, synthetic construct
  source 1..18: mol_type = other DNA
tagatcgtatcactatag

SEQ ID NO: 66303 - DNA, 18 bp, synthetic construct
  source 1..18: mol_type = other DNA
tagcacttctcacacttg

SEQ ID NO: 66304 - DNA, 18 bp, synthetic construct
  source 1..18: mol_type = other DNA
tagcaggactcgcaatag

SEQ ID NO: 66305 - DNA, 18 bp, synthetic construct
  source 1..18: mol_type = other DNA
taggaagtctcgctatcg

SEQ ID NO: 66306 - DNA, 18 bp, synthetic construct
  source 1..18: mol_type = other DNA
taggactactctctttag

SEQ ID NO: 66307 - DNA, 18 bp, synthetic construct
  source 1..18: mol_type = other DNA
tagtaagactcactcctg

SEQ ID NO: 66308 - DNA, 18 bp, synthetic construct
  source 1..18: mol_type = other DNA
tagtaagactctataaag

SEQ ID NO: 66309 - DNA, 18 bp, synthetic construct
  source 1..18: mol_type = other DNA
tagtacaactcatttaag

SEQ ID NO: 66310 - DNA, 18 bp, synthetic construct
  source 1..18: mol_type = other DNA
tagtacatctcattgtag

SEQ ID NO: 66311 - DNA, 18 bp, synthetic construct
  source 1..18: mol_type = other DNA
tagtacgacataccattg

SEQ ID NO: 66312 - DNA, 18 bp, synthetic construct
  source 1..18: mol_type = other DNA
tagtacgactaatttcag

SEQ ID NO: 66313 - DNA, 18 bp, synthetic construct
  source 1..18: mol_type = other DNA
tagtacgactcatatcag

SEQ ID NO: 66314 - DNA, 18 bp, synthetic construct
  source 1..18: mol_type = other DNA
tagtacgactttttaatg

SEQ ID NO: 66315 - DNA, 18 bp, synthetic construct
  source 1..18: mol_type = other DNA
tagtacgcctttcaaaag

SEQ ID NO: 66316 - DNA, 18 bp, synthetic construct
  source 1..18: mol_type = other DNA
tagtacgggtatatatag

SEQ ID NO: 66317 - DNA, 18 bp, synthetic construct
  source 1..18: mol_type = other DNA
tagtacgtcacacaacag

SEQ ID NO: 66318 - DNA, 18 bp, synthetic construct
  source 1..18: mol_type = other DNA
tagtacgtcacattgtag

SEQ ID NO: 66319 - DNA, 18 bp, synthetic construct
  source 1..18: mol_type = other DNA
tagtacgtcatatgattg

SEQ ID NO: 66320 - DNA, 18 bp, synthetic construct
  source 1..18: mol_type = other DNA
tagtacgtctaactcaag

SEQ ID NO: 66321 - DNA, 18 bp, synthetic construct
  source 1..18: mol_type = other DNA
tagtacgtctttctaaag

SEQ ID NO: 66322 - DNA, 18 bp, synthetic construct
  source 1..18: mol_type = other DNA
tagtactactcaatcgag

SEQ ID NO: 66323 - DNA, 18 bp, synthetic construct
  source 1..18: mol_type = other DNA
tagtacttgtcactatgg

SEQ ID NO: 66324 - DNA, 18 bp, synthetic construct
  source 1..18: mol_type = other DNA
tagtatcaatctctattg

SEQ ID NO: 66325 - DNA, 18 bp, synthetic construct
  source 1..18: mol_type = other DNA
tagtatgaccctcaatgg

SEQ ID NO: 66326 - DNA, 18 bp, synthetic construct
  source 1..18: mol_type = other DNA
tagtatgccacaataaag

SEQ ID NO: 66327 - DNA, 18 bp, synthetic construct
  source 1..18: mol_type = other DNA
tagtattactcaacgtag

SEQ ID NO: 66328 - DNA, 18 bp, synthetic construct
  source 1..18: mol_type = other DNA
tagtattactctctatcg

SEQ ID NO: 66329 - DNA, 18 bp, synthetic construct
  source 1..18: mol_type = other DNA
tagtccaactctcagtag

SEQ ID NO: 66330 - DNA, 18 bp, synthetic construct
  source 1..18: mol_type = other DNA
tagtcccactcacataag

SEQ ID NO: 66331 - DNA, 18 bp, synthetic construct
  source 1..18: mol_type = other DNA
tagtgcgtctcagattcg

SEQ ID NO: 66332 - DNA, 18 bp, synthetic construct
  source 1..18: mol_type = other DNA
tagttcaagtctctatag

SEQ ID NO: 66333 - DNA, 18 bp, synthetic construct
  source 1..18: mol_type = other DNA
tagttcgaatcgcatttg

SEQ ID NO: 66334 - DNA, 18 bp, synthetic construct
  source 1..18: mol_type = other DNA
tagttcgaattacatcag

SEQ ID NO: 66335 - DNA, 18 bp, synthetic construct
  source 1..18: mol_type = other DNA
tagttcttctcacagtag

SEQ ID NO: 66336 - DNA, 18 bp, synthetic construct
  source 1..18: mol_type = other DNA
tagtttcactcacaatag

SEQ ID NO: 66337 - DNA, 18 bp, synthetic construct
  source 1..18: mol_type = other DNA
tagttttaccctatatcg

SEQ ID NO: 66338 - DNA, 18 bp, synthetic construct
  source 1..18: mol_type = other DNA
tataaagactcattaaag

SEQ ID NO: 66339 - DNA, 18 bp, synthetic construct
  source 1..18: mol_type = other DNA
tataaagtgccactatag

SEQ ID NO: 66340 - DNA, 18 bp, synthetic construct
  source 1..18: mol_type = other DNA
tataacaactccgtacag

SEQ ID NO: 66341 - DNA, 18 bp, synthetic construct
  source 1..18: mol_type = other DNA
tataaccactctctaatg

SEQ ID NO: 66342 - DNA, 18 bp, synthetic construct
  source 1..18: mol_type = other DNA
tataacgacacttaatag

SEQ ID NO: 66343 - DNA, 18 bp, synthetic construct
  source 1..18: mol_type = other DNA
tataacgacgtacaatag

SEQ ID NO: 66344 - DNA, 18 bp, synthetic construct
  source 1..18: mol_type = other DNA
tataacgactaattaaag

SEQ ID NO: 66345 - DNA, 18 bp, synthetic construct
  source 1..18: mol_type = other DNA
tataacgactcacttacg

SEQ ID NO: 66346 - DNA, 18 bp, synthetic construct
  source 1..18: mol_type = other DNA
tataacgactctatttag

SEQ ID NO: 66347 - DNA, 18 bp, synthetic construct
  source 1..18: mol_type = other DNA
tataacgactctctaatg

SEQ ID NO: 66348 - DNA, 18 bp, synthetic construct
  source 1..18: mol_type = other DNA
tataacgactgactaatg

SEQ ID NO: 66349 - DNA, 18 bp, synthetic construct
  source 1..18: mol_type = other DNA
tataacgattaacgatgg

SEQ ID NO: 66350 - DNA, 18 bp, synthetic construct
  source 1..18: mol_type = other DNA
tataacgattgacattag

SEQ ID NO: 66351 - DNA, 18 bp, synthetic construct
  source 1..18: mol_type = other DNA
tataacgcctctcaatag

SEQ ID NO: 66352 - DNA, 18 bp, synthetic construct
  source 1..18: mol_type = other DNA
tataacggctcacattag

SEQ ID NO: 66353 - DNA, 18 bp, synthetic construct
  source 1..18: mol_type = other DNA
tataacgtaccgctaaag

SEQ ID NO: 66354 - DNA, 18 bp, synthetic construct
  source 1..18: mol_type = other DNA
tataactatgccatatcg

SEQ ID NO: 66355 - DNA, 18 bp, synthetic construct
  source 1..18: mol_type = other DNA
tataactcctcactatcg

SEQ ID NO: 66356 - DNA, 18 bp, synthetic construct
  source 1..18: mol_type = other DNA
tataacttctcaacaaag

SEQ ID NO: 66357 - DNA, 18 bp, synthetic construct
  source 1..18: mol_type = other DNA
tataacttctcactattg

SEQ ID NO: 66358 - DNA, 18 bp, synthetic construct
  source 1..18: mol_type = other DNA
tataagttctcactttag

SEQ ID NO: 66359 - DNA, 18 bp, synthetic construct
  source 1..18: mol_type = other DNA
tataataacatcatattg

SEQ ID NO: 66360 - DNA, 18 bp, synthetic construct
  source 1..18: mol_type = other DNA
tataatcaatgactatag

SEQ ID NO: 66361 - DNA, 18 bp, synthetic construct
  source 1..18: mol_type = other DNA
tataatgaaacaccattg

SEQ ID NO: 66362 - DNA, 18 bp, synthetic construct
  source 1..18: mol_type = other DNA
tataatgactcgatatag

SEQ ID NO: 66363 - DNA, 18 bp, synthetic construct
  source 1..18: mol_type = other DNA
tataatgtcccattgatg

SEQ ID NO: 66364 - DNA, 18 bp, synthetic construct
  source 1..18: mol_type = other DNA
tatacccaatctcaatag

SEQ ID NO: 66365 - DNA, 18 bp, synthetic construct
  source 1..18: mol_type = other DNA
tatactcactcattttag

SEQ ID NO: 66366 - DNA, 18 bp, synthetic construct
  source 1..18: mol_type = other DNA
tatagcgacactctttag

SEQ ID NO: 66367 - DNA, 18 bp, synthetic construct
  source 1..18: mol_type = other DNA
tatagcgactcaatgtag

SEQ ID NO: 66368 - DNA, 18 bp, synthetic construct
  source 1..18: mol_type = other DNA
tatagctactacctaaag

SEQ ID NO: 66369 - DNA, 18 bp, synthetic construct
  source 1..18: mol_type = other DNA
tatatcaactttcgatag

SEQ ID NO: 66370 - DNA, 18 bp, synthetic construct
  source 1..18: mol_type = other DNA
tatatcgattcaccatag

SEQ ID NO: 66371 - DNA, 18 bp, synthetic construct
  source 1..18: mol_type = other DNA
tatatcgattctctacag

SEQ ID NO: 66372 - DNA, 18 bp, synthetic construct
  source 1..18: mol_type = other DNA
tatatcgcctcattatag

SEQ ID NO: 66373 - DNA, 18 bp, synthetic construct
  source 1..18: mol_type = other DNA
tatatcgtctcacaatag

SEQ ID NO: 66374 - DNA, 18 bp, synthetic construct
  source 1..18: mol_type = other DNA
tatatggccaccctatag

SEQ ID NO: 66375 - DNA, 18 bp, synthetic construct
  source 1..18: mol_type = other DNA
tatatgggctcccaatcg

SEQ ID NO: 66376 - DNA, 18 bp, synthetic construct
  source 1..18: mol_type = other DNA
tatatttactatctaaag

SEQ ID NO: 66377 - DNA, 18 bp, synthetic construct
  source 1..18: mol_type = other DNA
tatcaagattcactttag

SEQ ID NO: 66378 - DNA, 18 bp, synthetic construct
  source 1..18: mol_type = other DNA
tatcacaccttactaaag

SEQ ID NO: 66379 - DNA, 18 bp, synthetic construct
  source 1..18: mol_type = other DNA
tatcacgacacattttag

SEQ ID NO: 66380 - DNA, 18 bp, synthetic construct
  source 1..18: mol_type = other DNA
tatcacgactaacaatgg

SEQ ID NO: 66381 - DNA, 18 bp, synthetic construct
  source 1..18: mol_type = other DNA
tatcacggatccctgtag

SEQ ID NO: 66382 - DNA, 18 bp, synthetic construct
  source 1..18: mol_type = other DNA
tatcacgtcccagtaaag

SEQ ID NO: 66383 - DNA, 18 bp, synthetic construct
  source 1..18: mol_type = other DNA
tatcataactcactattg

SEQ ID NO: 66384 - DNA, 18 bp, synthetic construct
  source 1..18: mol_type = other DNA
tatcatgacaccctctag

SEQ ID NO: 66385 - DNA, 18 bp, synthetic construct
  source 1..18: mol_type = other DNA
tatcgcgactctctattg

SEQ ID NO: 66386 - DNA, 18 bp, synthetic construct
  source 1..18: mol_type = other DNA
tatctcgacttgctacag

SEQ ID NO: 66387 - DNA, 18 bp, synthetic construct
  source 1..18: mol_type = other DNA
tatgaagaatcactgagg

SEQ ID NO: 66388 - DNA, 18 bp, synthetic construct
  source 1..18: mol_type = other DNA
tatgacgactcggtaaag

SEQ ID NO: 66389 - DNA, 18 bp, synthetic construct
  source 1..18: mol_type = other DNA
tatgaggacccaatatag

SEQ ID NO: 66390 - DNA, 18 bp, synthetic construct
  source 1..18: mol_type = other DNA
tatgccgtatttctaaag

SEQ ID NO: 66391 - DNA, 18 bp, synthetic construct
  source 1..18: mol_type = other DNA
tatgctgtctcactatag

SEQ ID NO: 66392 - DNA, 18 bp, synthetic construct
  source 1..18: mol_type = other DNA
tatgttgactcgcaattg

SEQ ID NO: 66393 - DNA, 18 bp, synthetic construct
  source 1..18: mol_type = other DNA
tattaacactctttaaag

SEQ ID NO: 66394 - DNA, 18 bp, synthetic construct
  source 1..18: mol_type = other DNA
tattaagattcaatttag

SEQ ID NO: 66395 - DNA, 18 bp, synthetic construct
  source 1..18: mol_type = other DNA
tattaaggctcactaatg

SEQ ID NO: 66396 - DNA, 18 bp, synthetic construct
  source 1..18: mol_type = other DNA
tattaatactcccataag

SEQ ID NO: 66397 - DNA, 18 bp, synthetic construct
  source 1..18: mol_type = other DNA
tattaatgatcactatag

SEQ ID NO: 66398 - DNA, 18 bp, synthetic construct
  source 1..18: mol_type = other DNA
tattaattctcactaaag

SEQ ID NO: 66399 - DNA, 18 bp, synthetic construct
  source 1..18: mol_type = other DNA
tattacaactcaccaatg

SEQ ID NO: 66400 - DNA, 18 bp, synthetic construct
  source 1..18: mol_type = other DNA
tattacaactcacttcgg

SEQ ID NO: 66401 - DNA, 18 bp, synthetic construct
  source 1..18: mol_type = other DNA
tattacaactctccactg

SEQ ID NO: 66402 - DNA, 18 bp, synthetic construct
  source 1..18: mol_type = other DNA
tattacatctctctctag

SEQ ID NO: 66403 - DNA, 18 bp, synthetic construct
  source 1..18: mol_type = other DNA
tattacatcttctaatag

SEQ ID NO: 66404 - DNA, 18 bp, synthetic construct
  source 1..18: mol_type = other DNA
tattaccacccactaccg

SEQ ID NO: 66405 - DNA, 18 bp, synthetic construct
  source 1..18: mol_type = other DNA
tattaccactcacttatg

SEQ ID NO: 66406 - DNA, 18 bp, synthetic construct
  source 1..18: mol_type = other DNA
tattacgaaacaatctag

SEQ ID NO: 66407 - DNA, 18 bp, synthetic construct
  source 1..18: mol_type = other DNA
tattacgaatagctttag

SEQ ID NO: 66408 - DNA, 18 bp, synthetic construct
  source 1..18: mol_type = other DNA
tattacgaatcactcatg

SEQ ID NO: 66409 - DNA, 18 bp, synthetic construct
  source 1..18: mol_type = other DNA
tattacgaatctcaattg

SEQ ID NO: 66410 - DNA, 18 bp, synthetic construct
  source 1..18: mol_type = other DNA
tattacgacacccaacag

SEQ ID NO: 66411 - DNA, 18 bp, synthetic construct
  source 1..18: mol_type = other DNA
tattacgaccacctacag

SEQ ID NO: 66412 - DNA, 18 bp, synthetic construct
  source 1..18: mol_type = other DNA
tattacgacttacatttg

SEQ ID NO: 66413 - DNA, 18 bp, synthetic construct
  source 1..18: mol_type = other DNA
tattacgacttatattag

SEQ ID NO: 66414 - DNA, 18 bp, synthetic construct
  source 1..18: mol_type = other DNA
tattacgagtaacttatg

SEQ ID NO: 66415 - DNA, 18 bp, synthetic construct
  source 1..18: mol_type = other DNA
tattacgatcctctattg

SEQ ID NO: 66416 - DNA, 18 bp, synthetic construct
  source 1..18: mol_type = other DNA
tattacgattgtctaaag

SEQ ID NO: 66417 - DNA, 18 bp, synthetic construct
  source 1..18: mol_type = other DNA
tattacgcttctttatag

SEQ ID NO: 66418 - DNA, 18 bp, synthetic construct
  source 1..18: mol_type = other DNA
tattacggatcacttaag

SEQ ID NO: 66419 - DNA, 18 bp, synthetic construct
  source 1..18: mol_type = other DNA
tattacggcttactagtg

SEQ ID NO: 66420 - DNA, 18 bp, synthetic construct
  source 1..18: mol_type = other DNA
tattacgtaacactcttg

SEQ ID NO: 66421 - DNA, 18 bp, synthetic construct
  source 1..18: mol_type = other DNA
tattacgtatcgatattg

SEQ ID NO: 66422 - DNA, 18 bp, synthetic construct
  source 1..18: mol_type = other DNA
tattacgtcacagtgtag

SEQ ID NO: 66423 - DNA, 18 bp, synthetic construct
  source 1..18: mol_type = other DNA
tattacgtcccagtttag

SEQ ID NO: 66424 - DNA, 18 bp, synthetic construct
  source 1..18: mol_type = other DNA
tattacgtcccccaatag

SEQ ID NO: 66425 - DNA, 18 bp, synthetic construct
  source 1..18: mol_type = other DNA
tattacgtctcacagttg

SEQ ID NO: 66426 - DNA, 18 bp, synthetic construct
  source 1..18: mol_type = other DNA
tattacgtctcgccaaag

SEQ ID NO: 66427 - DNA, 18 bp, synthetic construct
  source 1..18: mol_type = other DNA
tattacgtctctatttag

SEQ ID NO: 66428 - DNA, 18 bp, synthetic construct
  source 1..18: mol_type = other DNA
tattacgtctctctgttg

SEQ ID NO: 66429 - DNA, 18 bp, synthetic construct
  source 1..18: mol_type = other DNA
tattacgtgtaattacag

SEQ ID NO: 66430 - DNA, 18 bp, synthetic construct
  source 1..18: mol_type = other DNA
tattacgttactctagtg

SEQ ID NO: 66431 - DNA, 18 bp, synthetic construct
  source 1..18: mol_type = other DNA
tattacgttcctctatag

SEQ ID NO: 66432 - DNA, 18 bp, synthetic construct
  source 1..18: mol_type = other DNA
tattacgtttaacactag

SEQ ID NO: 66433 - DNA, 18 bp, synthetic construct
  source 1..18: mol_type = other DNA
tattacgtttcaccacag

SEQ ID NO: 66434 - DNA, 18 bp, synthetic construct
  source 1..18: mol_type = other DNA
tattactaatcagttttg

SEQ ID NO: 66435 - DNA, 18 bp, synthetic construct
  source 1..18: mol_type = other DNA
tattactacacatcatag

SEQ ID NO: 66436 - DNA, 18 bp, synthetic construct
  source 1..18: mol_type = other DNA
tattactactccctaatg

SEQ ID NO: 66437 - DNA, 18 bp, synthetic construct
  source 1..18: mol_type = other DNA
tattactacttgctttag

SEQ ID NO: 66438 - DNA, 18 bp, synthetic construct
  source 1..18: mol_type = other DNA
tattactagacactattg

SEQ ID NO: 66439 - DNA, 18 bp, synthetic construct
  source 1..18: mol_type = other DNA
tattactaggtttcatag

SEQ ID NO: 66440 - DNA, 18 bp, synthetic construct
  source 1..18: mol_type = other DNA
tattactattctctaaag

SEQ ID NO: 66441 - DNA, 18 bp, synthetic construct
  source 1..18: mol_type = other DNA
tattactgctcacgattg

SEQ ID NO: 66442 - DNA, 18 bp, synthetic construct
  source 1..18: mol_type = other DNA
tattacttcacattatag

SEQ ID NO: 66443 - DNA, 18 bp, synthetic construct
  source 1..18: mol_type = other DNA
tattacttcactctatag

SEQ ID NO: 66444 - DNA, 18 bp, synthetic construct
  source 1..18: mol_type = other DNA
tattacttctcattaaag

SEQ ID NO: 66445 - DNA, 18 bp, synthetic construct
  source 1..18: mol_type = other DNA
tattacttctcgctaacg

SEQ ID NO: 66446 - DNA, 18 bp, synthetic construct
  source 1..18: mol_type = other DNA
tattaggactaacttaag

SEQ ID NO: 66447 - DNA, 18 bp, synthetic construct
  source 1..18: mol_type = other DNA
tattaggactcaaaaaag

SEQ ID NO: 66448 - DNA, 18 bp, synthetic construct
  source 1..18: mol_type = other DNA
tattaggactcctttgag

SEQ ID NO: 66449 - DNA, 18 bp, synthetic construct
  source 1..18: mol_type = other DNA
tattaggtccgaataatg

SEQ ID NO: 66450 - DNA, 18 bp, synthetic construct
  source 1..18: mol_type = other DNA
tattataaatctctattg

SEQ ID NO: 66451 - DNA, 18 bp, synthetic construct
  source 1..18: mol_type = other DNA
tattataactccttttag

SEQ ID NO: 66452 - DNA, 18 bp, synthetic construct
  source 1..18: mol_type = other DNA
tattatatctcattatag

SEQ ID NO: 66453 - DNA, 18 bp, synthetic construct
  source 1..18: mol_type = other DNA
tattatctctctcaatag

SEQ ID NO: 66454 - DNA, 18 bp, synthetic construct
  source 1..18: mol_type = other DNA
tattatgaatatctatcg

SEQ ID NO: 66455 - DNA, 18 bp, synthetic construct
  source 1..18: mol_type = other DNA
tattatgacgcaccattg

SEQ ID NO: 66456 - DNA, 18 bp, synthetic construct
  source 1..18: mol_type = other DNA
tattatgactcacatttg

SEQ ID NO: 66457 - DNA, 18 bp, synthetic construct
  source 1..18: mol_type = other DNA
tattatgactctatttag

SEQ ID NO: 66458 - DNA, 18 bp, synthetic construct
  source 1..18: mol_type = other DNA
tattattcctcagaatag

SEQ ID NO: 66459 - DNA, 18 bp, synthetic construct
  source 1..18: mol_type = other DNA
tattcagactcactaatg

SEQ ID NO: 66460 - DNA, 18 bp, synthetic construct
  source 1..18: mol_type = other DNA
tattccaactcacaatcg

SEQ ID NO: 66461 - DNA, 18 bp, synthetic construct
  source 1..18: mol_type = other DNA
tattccgaaactctattg

SEQ ID NO: 66462 - DNA, 18 bp, synthetic construct
  source 1..18: mol_type = other DNA
tattccgtcgcactaaag

SEQ ID NO: 66463 - DNA, 18 bp, synthetic construct
  source 1..18: mol_type = other DNA
tattcggcctcagacaag

SEQ ID NO: 66464 - DNA, 18 bp, synthetic construct
  source 1..18: mol_type = other DNA
tattgcaactcacatctg

SEQ ID NO: 66465 - DNA, 18 bp, synthetic construct
  source 1..18: mol_type = other DNA
tattgcaataaactgtag

SEQ ID NO: 66466 - DNA, 18 bp, synthetic construct
  source 1..18: mol_type = other DNA
tattgcaatgcagactag

SEQ ID NO: 66467 - DNA, 18 bp, synthetic construct
  source 1..18: mol_type = other DNA
tattgcatctcactatgg

SEQ ID NO: 66468 - DNA, 18 bp, synthetic construct
  source 1..18: mol_type = other DNA
tattgcatctcactattg

SEQ ID NO: 66469 - DNA, 18 bp, synthetic construct
  source 1..18: mol_type = other DNA
tattgcgcttcactgttg

SEQ ID NO: 66470 - DNA, 18 bp, synthetic construct
  source 1..18: mol_type = other DNA
tattgcggagccctatag

SEQ ID NO: 66471 - DNA, 18 bp, synthetic construct
  source 1..18: mol_type = other DNA
tattgcgtctcacagtag

SEQ ID NO: 66472 - DNA, 18 bp, synthetic construct
  source 1..18: mol_type = other DNA
tattgcgtctcggttagg

SEQ ID NO: 66473 - DNA, 18 bp, synthetic construct
  source 1..18: mol_type = other DNA
tattgcgtttcctcatag

SEQ ID NO: 66474 - DNA, 18 bp, synthetic construct
  source 1..18: mol_type = other DNA
tattgctactcacactag

SEQ ID NO: 66475 - DNA, 18 bp, synthetic construct
  source 1..18: mol_type = other DNA
tattgcttctaactatcg

SEQ ID NO: 66476 - DNA, 18 bp, synthetic construct
  source 1..18: mol_type = other DNA
tattgttacttagcattg

SEQ ID NO: 66477 - DNA, 18 bp, synthetic construct
  source 1..18: mol_type = other DNA
tatttacaatccctagcg

SEQ ID NO: 66478 - DNA, 18 bp, synthetic construct
  source 1..18: mol_type = other DNA
tatttagactgaccatag

SEQ ID NO: 66479 - DNA, 18 bp, synthetic construct
  source 1..18: mol_type = other DNA
tatttagtcttaccatag

SEQ ID NO: 66480 - DNA, 18 bp, synthetic construct
  source 1..18: mol_type = other DNA
tatttcaactcaccacag

SEQ ID NO: 66481 - DNA, 18 bp, synthetic construct
  source 1..18: mol_type = other DNA
tatttcatctcactcttg

SEQ ID NO: 66482 - DNA, 18 bp, synthetic construct
  source 1..18: mol_type = other DNA
tatttccacggaccatag

SEQ ID NO: 66483 - DNA, 18 bp, synthetic construct
  source 1..18: mol_type = other DNA
tatttcgacaaactaaag

SEQ ID NO: 66484 - DNA, 18 bp, synthetic construct
  source 1..18: mol_type = other DNA
tatttcgacagtctaaag

SEQ ID NO: 66485 - DNA, 18 bp, synthetic construct
  source 1..18: mol_type = other DNA
tatttcgactcctcatag

SEQ ID NO: 66486 - DNA, 18 bp, synthetic construct
  source 1..18: mol_type = other DNA
tatttcgatcgacaaatg

SEQ ID NO: 66487 - DNA, 18 bp, synthetic construct
  source 1..18: mol_type = other DNA
tatttcgattcactttgg

SEQ ID NO: 66488 - DNA, 18 bp, synthetic construct
  source 1..18: mol_type = other DNA
tatttcgtatctttatag

SEQ ID NO: 66489 - DNA, 18 bp, synthetic construct
  source 1..18: mol_type = other DNA
tatttcgtctaactattg

SEQ ID NO: 66490 - DNA, 18 bp, synthetic construct
  source 1..18: mol_type = other DNA
tatttcgtctcaccttgg

SEQ ID NO: 66491 - DNA, 18 bp, synthetic construct
  source 1..18: mol_type = other DNA
tatttctaataactatag

SEQ ID NO: 66492 - DNA, 18 bp, synthetic construct
  source 1..18: mol_type = other DNA
tatttctaccctctatag

SEQ ID NO: 66493 - DNA, 18 bp, synthetic construct
  source 1..18: mol_type = other DNA
tatttctcctctctatag

SEQ ID NO: 66494 - DNA, 18 bp, synthetic construct
  source 1..18: mol_type = other DNA
tatttctgctaactaaag

SEQ ID NO: 66495 - DNA, 18 bp, synthetic construct
  source 1..18: mol_type = other DNA
tatttcttatcgctaaag

SEQ ID NO: 66496 - DNA, 18 bp, synthetic construct
  source 1..18: mol_type = other DNA
tatttcttcacacaattg

SEQ ID NO: 66497 - DNA, 18 bp, synthetic construct
  source 1..18: mol_type = other DNA
tatttcttctaactattg

SEQ ID NO: 66498 - DNA, 18 bp, synthetic construct
  source 1..18: mol_type = other DNA
tatttggtcactctacag

SEQ ID NO: 66499 - DNA, 18 bp, synthetic construct
  source 1..18: mol_type = other DNA
tattttgaaccaatatag

SEQ ID NO: 66500 - DNA, 18 bp, synthetic construct
  source 1..18: mol_type = other DNA
tattttgactctctattg

SEQ ID NO: 66501 - DNA, 18 bp, synthetic construct
  source 1..18: mol_type = other DNA
tattttgtcccactatag

SEQ ID NO: 66502 - DNA, 18 bp, synthetic construct
  source 1..18: mol_type = other DNA
tattttgtcgccctattg

SEQ ID NO: 66503 - DNA, 18 bp, synthetic construct
  source 1..18: mol_type = other DNA
tatttttactcactaatg

SEQ ID NO: 66504 - DNA, 18 bp, synthetic construct
  source 1..18: mol_type = other DNA
tcaaaagcctctctattg

SEQ ID NO: 66505 - DNA, 18 bp, synthetic construct
  source 1..18: mol_type = other DNA
tcaaaagcggcacaattg

SEQ ID NO: 66506 - DNA, 18 bp, synthetic construct
  source 1..18: mol_type = other DNA
tcaaaccattcattactg

SEQ ID NO: 66507 - DNA, 18 bp, synthetic construct
  source 1..18: mol_type = other DNA
tcaaacgacacaccgttg

SEQ ID NO: 66508 - DNA, 18 bp, synthetic construct
  source 1..18: mol_type = other DNA
tcaaacgaccccctaaag

SEQ ID NO: 66509 - DNA, 18 bp, synthetic construct
  source 1..18: mol_type = other DNA
tcaaacgattcacatcag

SEQ ID NO: 66510 - DNA, 18 bp, synthetic construct
  source 1..18: mol_type = other DNA
tcaaaggactcattattg

SEQ ID NO: 66511 - DNA, 18 bp, synthetic construct
  source 1..18: mol_type = other DNA
tcaaattacacattatag

SEQ ID NO: 66512 - DNA, 18 bp, synthetic construct
  source 1..18: mol_type = other DNA
tcaagccacgatcaagag

SEQ ID NO: 66513 - DNA, 18 bp, synthetic construct
  source 1..18: mol_type = other DNA
tcaatcgaatcggtatag

SEQ ID NO: 66514 - DNA, 18 bp, synthetic construct
  source 1..18: mol_type = other DNA
tcaatcgacacactaatg

SEQ ID NO: 66515 - DNA, 18 bp, synthetic construct
  source 1..18: mol_type = other DNA
tcaatcgtctgactaatg

SEQ ID NO: 66516 - DNA, 18 bp, synthetic construct
  source 1..18: mol_type = other DNA
tcaatctactcaattcag

SEQ ID NO: 66517 - DNA, 18 bp, synthetic construct
  source 1..18: mol_type = other DNA
tcacaagaaacacttttg

SEQ ID NO: 66518 - DNA, 18 bp, synthetic construct
  source 1..18: mol_type = other DNA
tcacataacccaatatag

SEQ ID NO: 66519 - DNA, 18 bp, synthetic construct
  source 1..18: mol_type = other DNA
tcagacgacagaccaaag

SEQ ID NO: 66520 - DNA, 18 bp, synthetic construct
  source 1..18: mol_type = other DNA
tcataagacccactcttg

SEQ ID NO: 66521 - DNA, 18 bp, synthetic construct
  source 1..18: mol_type = other DNA
tcataagtcacacgattg

SEQ ID NO: 66522 - DNA, 18 bp, synthetic construct
  source 1..18: mol_type = other DNA
tcataattcatagtcaag

SEQ ID NO: 66523 - DNA, 18 bp, synthetic construct
  source 1..18: mol_type = other DNA
tcatacaactaaccattg

SEQ ID NO: 66524 - DNA, 18 bp, synthetic construct
  source 1..18: mol_type = other DNA
tcatacgaattactctgg

SEQ ID NO: 66525 - DNA, 18 bp, synthetic construct
  source 1..18: mol_type = other DNA
tcatacgaccaacaattg

SEQ ID NO: 66526 - DNA, 18 bp, synthetic construct
  source 1..18: mol_type = other DNA
tcatacgagtctttatcg

SEQ ID NO: 66527 - DNA, 18 bp, synthetic construct
  source 1..18: mol_type = other DNA
tcatacgtcactttatag

SEQ ID NO: 66528 - DNA, 18 bp, synthetic construct
  source 1..18: mol_type = other DNA
tcatactaaacactaacg

SEQ ID NO: 66529 - DNA, 18 bp, synthetic construct
  source 1..18: mol_type = other DNA
tcatactagccaccttag

SEQ ID NO: 66530 - DNA, 18 bp, synthetic construct
  source 1..18: mol_type = other DNA
tcatacttctctcaatag

SEQ ID NO: 66531 - DNA, 18 bp, synthetic construct
  source 1..18: mol_type = other DNA
tcataggactcacatttg

SEQ ID NO: 66532 - DNA, 18 bp, synthetic construct
  source 1..18: mol_type = other DNA
tcataggattcgctattg

SEQ ID NO: 66533 - DNA, 18 bp, synthetic construct
  source 1..18: mol_type = other DNA
tcatatcactcgctatcg

SEQ ID NO: 66534 - DNA, 18 bp, synthetic construct
  source 1..18: mol_type = other DNA
tcatatcactctcattag

SEQ ID NO: 66535 - DNA, 18 bp, synthetic construct
  source 1..18: mol_type = other DNA
tcatatgactcgcttttg

SEQ ID NO: 66536 - DNA, 18 bp, synthetic construct
  source 1..18: mol_type = other DNA
tcatattaccctatattg

SEQ ID NO: 66537 - DNA, 18 bp, synthetic construct
  source 1..18: mol_type = other DNA
tcatccaacttacaaatg

SEQ ID NO: 66538 - DNA, 18 bp, synthetic construct
  source 1..18: mol_type = other DNA
tcatccgaatcattttag

SEQ ID NO: 66539 - DNA, 18 bp, synthetic construct
  source 1..18: mol_type = other DNA
tcatccgatcctataacg

SEQ ID NO: 66540 - DNA, 18 bp, synthetic construct
  source 1..18: mol_type = other DNA
tcatgcgacgcatagaag

SEQ ID NO: 66541 - DNA, 18 bp, synthetic construct
  source 1..18: mol_type = other DNA
tcatgggacacacaatag

SEQ ID NO: 66542 - DNA, 18 bp, synthetic construct
  source 1..18: mol_type = other DNA
tcatgtgtctcaatatag

SEQ ID NO: 66543 - DNA, 18 bp, synthetic construct
  source 1..18: mol_type = other DNA
tcattcgcttcgctatcg

SEQ ID NO: 66544 - DNA, 18 bp, synthetic construct
  source 1..18: mol_type = other DNA
tcattcgcttctctctag

SEQ ID NO: 66545 - DNA, 18 bp, synthetic construct
  source 1..18: mol_type = other DNA
tcattcggctcagtatcg

SEQ ID NO: 66546 - DNA, 18 bp, synthetic construct
  source 1..18: mol_type = other DNA
tcattcgtctcaataacg

SEQ ID NO: 66547 - DNA, 18 bp, synthetic construct
  source 1..18: mol_type = other DNA
tcattcgtttaactatag

SEQ ID NO: 66548 - DNA, 18 bp, synthetic construct
  source 1..18: mol_type = other DNA
tcattgaactaactcgtg

SEQ ID NO: 66549 - DNA, 18 bp, synthetic construct
  source 1..18: mol_type = other DNA
tcccacgactcaagcaag

SEQ ID NO: 66550 - DNA, 18 bp, synthetic construct
  source 1..18: mol_type = other DNA
tcctactttacactttag

SEQ ID NO: 66551 - DNA, 18 bp, synthetic construct
  source 1..18: mol_type = other DNA
tccttcaactcgccaaag

SEQ ID NO: 66552 - DNA, 18 bp, synthetic construct
  source 1..18: mol_type = other DNA
tccttcgattgaatattg

SEQ ID NO: 66553 - DNA, 18 bp, synthetic construct
  source 1..18: mol_type = other DNA
tcgaaccaaacactattg

SEQ ID NO: 66554 - DNA, 18 bp, synthetic construct
  source 1..18: mol_type = other DNA
tcggacctcacactatag

SEQ ID NO: 66555 - DNA, 18 bp, synthetic construct
  source 1..18: mol_type = other DNA
tcgtaccattaacgaatg

SEQ ID NO: 66556 - DNA, 18 bp, synthetic construct
  source 1..18: mol_type = other DNA
tcgtacgacactctatcg

SEQ ID NO: 66557 - DNA, 18 bp, synthetic construct
  source 1..18: mol_type = other DNA
tcgtactatttacaatag

SEQ ID NO: 66558 - DNA, 18 bp, synthetic construct
  source 1..18: mol_type = other DNA
tctaaccactcaccattg

SEQ ID NO: 66559 - DNA, 18 bp, synthetic construct
  source 1..18: mol_type = other DNA
tcttaccactcactactg

SEQ ID NO: 66560 - DNA, 18 bp, synthetic construct
  source 1..18: mol_type = other DNA
tcttacgaatctgtatag

SEQ ID NO: 66561 - DNA, 18 bp, synthetic construct
  source 1..18: mol_type = other DNA
tcttacgacacggtttag

SEQ ID NO: 66562 - DNA, 18 bp, synthetic construct
  source 1..18: mol_type = other DNA
tcttccaactcagttcag

SEQ ID NO: 66563 - DNA, 18 bp, synthetic construct
  source 1..18: mol_type = other DNA
tcttcccattcaatatag

SEQ ID NO: 66564 - DNA, 18 bp, synthetic construct
  source 1..18: mol_type = other DNA
tctttcaactgactaaag

SEQ ID NO: 66565 - DNA, 18 bp, synthetic construct
  source 1..18: mol_type = other DNA
tctttcgactctatatag

SEQ ID NO: 66566 - DNA, 18 bp, synthetic construct
  source 1..18: mol_type = other DNA
tctttggtcttactattg

SEQ ID NO: 66567 - DNA, 18 bp, synthetic construct
  source 1..18: mol_type = other DNA
tgaaacaacacactatgg

SEQ ID NO: 66568 - DNA, 18 bp, synthetic construct
  source 1..18: mol_type = other DNA
tgaaacaactcactttgg

SEQ ID NO: 66569 - DNA, 18 bp, synthetic construct
  source 1..18: mol_type = other DNA
tgaaaccactctctggag

SEQ ID NO: 66570 - DNA, 18 bp, synthetic construct
  source 1..18: mol_type = other DNA
tgaaaccgctcaataaag

SEQ ID NO: 66571 - DNA, 18 bp, synthetic construct
  source 1..18: mol_type = other DNA
tgaaacgattgactattg

SEQ ID NO: 66572 - DNA, 18 bp, synthetic construct
  source 1..18: mol_type = other DNA
tgaaacggcacactattg

SEQ ID NO: 66573 - DNA, 18 bp, synthetic construct
  source 1..18: mol_type = other DNA
tgaaattacccaatttcg

SEQ ID NO: 66574 - DNA, 18 bp, synthetic construct
  source 1..18: mol_type = other DNA
tgaaattactctctatag

SEQ ID NO: 66575 - DNA, 18 bp, synthetic construct
  source 1..18: mol_type = other DNA
tgaagcatctcattatag

SEQ ID NO: 66576 - DNA, 18 bp, synthetic construct
  source 1..18: mol_type = other DNA
tgaagcgattcacaattg

SEQ ID NO: 66577 - DNA, 18 bp, synthetic construct
  source 1..18: mol_type = other DNA
tgaatcttttaaagatag

SEQ ID NO: 66578 - DNA, 18 bp, synthetic construct
  source 1..18: mol_type = other DNA
tgacaagactcacaacgg

SEQ ID NO: 66579 - DNA, 18 bp, synthetic construct
  source 1..18: mol_type = other DNA
tgacacgatttacataag

SEQ ID NO: 66580 - DNA, 18 bp, synthetic construct
  source 1..18: mol_type = other DNA
tgacacgatttaccttag

SEQ ID NO: 66581 - DNA, 18 bp, synthetic construct
  source 1..18: mol_type = other DNA
tgactcaactcactattg

SEQ ID NO: 66582 - DNA, 18 bp, synthetic construct
  source 1..18: mol_type = other DNA
tgatacaacttacttatg

SEQ ID NO: 66583 - DNA, 18 bp, synthetic construct
  source 1..18: mol_type = other DNA
tgatacgaatctcttcag

SEQ ID NO: 66584 - DNA, 18 bp, synthetic construct
  source 1..18: mol_type = other DNA
tgatacgacacaccttcg

SEQ ID NO: 66585 - DNA, 18 bp, synthetic construct
  source 1..18: mol_type = other DNA
tgatacgacgcaccaccg

SEQ ID NO: 66586 - DNA, 18 bp, synthetic construct
  source 1..18: mol_type = other DNA
tgatacgactctctgagg

SEQ ID NO: 66587 - DNA, 18 bp, synthetic construct
  source 1..18: mol_type = other DNA
tgatacgatttagtagag

SEQ ID NO: 66588 - DNA, 18 bp, synthetic construct
  source 1..18: mol_type = other DNA
tgatacgcacaactatcg

SEQ ID NO: 66589 - DNA, 18 bp, synthetic construct
  source 1..18: mol_type = other DNA
tgatacgcgtcacgtaag

SEQ ID NO: 66590 - DNA, 18 bp, synthetic construct
  source 1..18: mol_type = other DNA
tgatacgctccacgatag

SEQ ID NO: 66591 - DNA, 18 bp, synthetic construct
  source 1..18: mol_type = other DNA
tgatacgtctccccattg

SEQ ID NO: 66592 - DNA, 18 bp, synthetic construct
  source 1..18: mol_type = other DNA
tgatacgtctctccaaag

SEQ ID NO: 66593 - DNA, 18 bp, synthetic construct
  source 1..18: mol_type = other DNA
tgatactggtcagtatag

SEQ ID NO: 66594 - DNA, 18 bp, synthetic construct
  source 1..18: mol_type = other DNA
tgatccctttcactaagg

SEQ ID NO: 66595 - DNA, 18 bp, synthetic construct
  source 1..18: mol_type = other DNA
tgatgctacgctttattg

SEQ ID NO: 66596 - DNA, 18 bp, synthetic construct
  source 1..18: mol_type = other DNA
tgattagactcactaatg

SEQ ID NO: 66597 - DNA, 18 bp, synthetic construct
  source 1..18: mol_type = other DNA
tgattcgactcaattcag

SEQ ID NO: 66598 - DNA, 18 bp, synthetic construct
  source 1..18: mol_type = other DNA
tgattcgtttgacaattg

SEQ ID NO: 66599 - DNA, 18 bp, synthetic construct
  source 1..18: mol_type = other DNA
tgattgaactaacttctg

SEQ ID NO: 66600 - DNA, 18 bp, synthetic construct
  source 1..18: mol_type = other DNA
tgcaacgaataactatag

SEQ ID NO: 66601 - DNA, 18 bp, synthetic construct
  source 1..18: mol_type = other DNA
tgccgtgatttactatcg

SEQ ID NO: 66602 - DNA, 18 bp, synthetic construct
  source 1..18: mol_type = other DNA
tgcgacgacactctttag

SEQ ID NO: 66603 - DNA, 18 bp, synthetic construct
  source 1..18: mol_type = other DNA
tgcttcgacacagtgatg

SEQ ID NO: 66604 - DNA, 18 bp, synthetic construct
  source 1..18: mol_type = other DNA
tggaacgagttactatag

SEQ ID NO: 66605 - DNA, 18 bp, synthetic construct
  source 1..18: mol_type = other DNA
tggaccgaacctctatag

SEQ ID NO: 66606 - DNA, 18 bp, synthetic construct
  source 1..18: mol_type = other DNA
tggcgcgatacactattg

SEQ ID NO: 66607 - DNA, 18 bp, synthetic construct
  source 1..18: mol_type = other DNA
tggtacgtcgcactattg

SEQ ID NO: 66608 - DNA, 18 bp, synthetic construct
  source 1..18: mol_type = other DNA
tggtactactcacactag

SEQ ID NO: 66609 - DNA, 18 bp, synthetic construct
  source 1..18: mol_type = other DNA
tgtaacgacactatatag

SEQ ID NO: 66610 - DNA, 18 bp, synthetic construct
  source 1..18: mol_type = other DNA
tgtaacgactcaacattg

SEQ ID NO: 66611 - DNA, 18 bp, synthetic construct
  source 1..18: mol_type = other DNA
tgtaacgacttagtatag

SEQ ID NO: 66612 - DNA, 18 bp, synthetic construct
  source 1..18: mol_type = other DNA
tgtaacgtttaaccttag

SEQ ID NO: 66613 - DNA, 18 bp, synthetic construct
  source 1..18: mol_type = other DNA
tgtaacttctcactatag

SEQ ID NO: 66614 - DNA, 18 bp, synthetic construct
  source 1..18: mol_type = other DNA
tgtatcgtcataccattg

SEQ ID NO: 66615 - DNA, 18 bp, synthetic construct
  source 1..18: mol_type = other DNA
tgtgacgtcttactttag

SEQ ID NO: 66616 - DNA, 18 bp, synthetic construct
  source 1..18: mol_type = other DNA
tgttaagacactctattg

SEQ ID NO: 66617 - DNA, 18 bp, synthetic construct
  source 1..18: mol_type = other DNA
tgttaatacacagtatag

SEQ ID NO: 66618 - DNA, 18 bp, synthetic construct
  source 1..18: mol_type = other DNA
tgttaatactcactgaag

SEQ ID NO: 66619 - DNA, 18 bp, synthetic construct
  source 1..18: mol_type = other DNA
tgttactaatcaccatag

SEQ ID NO: 66620 - DNA, 18 bp, synthetic construct
  source 1..18: mol_type = other DNA
tgttactacaagctatag

SEQ ID NO: 66621 - DNA, 18 bp, synthetic construct
  source 1..18: mol_type = other DNA
tgttgcgtctcacgggag

SEQ ID NO: 66622 - DNA, 18 bp, synthetic construct
  source 1..18: mol_type = other DNA
tgttgctactcacaatag

SEQ ID NO: 66623 - DNA, 18 bp, synthetic construct
  source 1..18: mol_type = other DNA
tgtttcgtctcaccatcg

SEQ ID NO: 66624 - DNA, 18 bp, synthetic construct
  source 1..18: mol_type = other DNA
ttaaaaaattcactatag

SEQ ID NO: 66625 - DNA, 18 bp, synthetic construct
  source 1..18: mol_type = other DNA
ttaaaagatacactatag

SEQ ID NO: 66626 - DNA, 18 bp, synthetic construct
  source 1..18: mol_type = other DNA
ttaaacaacatactcatg

SEQ ID NO: 66627 - DNA, 18 bp, synthetic construct
  source 1..18: mol_type = other DNA
ttaaacgacacactactg

SEQ ID NO: 66628 - DNA, 18 bp, synthetic construct
  source 1..18: mol_type = other DNA
ttaaacgaccgtatatag

SEQ ID NO: 66629 - DNA, 18 bp, synthetic construct
  source 1..18: mol_type = other DNA
ttaaacgactctcttcgg

SEQ ID NO: 66630 - DNA, 18 bp, synthetic construct
  source 1..18: mol_type = other DNA
ttaaacgacttactcaag

SEQ ID NO: 66631 - DNA, 18 bp, synthetic construct
  source 1..18: mol_type = other DNA
ttaaacggctcaatatgg

SEQ ID NO: 66632 - DNA, 18 bp, synthetic construct
  source 1..18: mol_type = other DNA
ttaaactactcaatctag

SEQ ID NO: 66633 - DNA, 18 bp, synthetic construct
  source 1..18: mol_type = other DNA
ttaaactactcacttcag

SEQ ID NO: 66634 - DNA, 18 bp, synthetic construct
  source 1..18: mol_type = other DNA
ttaaactactctctttag

SEQ ID NO: 66635 - DNA, 18 bp, synthetic construct
  source 1..18: mol_type = other DNA
ttaaactagtctctacag

SEQ ID NO: 66636 - DNA, 18 bp, synthetic construct
  source 1..18: mol_type = other DNA
ttaaactgctcactatcg

SEQ ID NO: 66637 - DNA, 18 bp, synthetic construct
  source 1..18: mol_type = other DNA
ttaaaggtatcactatag

SEQ ID NO: 66638 - DNA, 18 bp, synthetic construct
  source 1..18: mol_type = other DNA
ttaaatcacctactatag

SEQ ID NO: 66639 - DNA, 18 bp, synthetic construct
  source 1..18: mol_type = other DNA
ttaaatgcctcactattg

SEQ ID NO: 66640 - DNA, 18 bp, synthetic construct
  source 1..18: mol_type = other DNA
ttaaatggctcactaatg

SEQ ID NO: 66641 - DNA, 18 bp, synthetic construct
  source 1..18: mol_type = other DNA
ttaaccgacccacattgg

SEQ ID NO: 66642 - DNA, 18 bp, synthetic construct
  source 1..18: mol_type = other DNA
ttaaccgactaaatatag

SEQ ID NO: 66643 - DNA, 18 bp, synthetic construct
  source 1..18: mol_type = other DNA
ttaaccgattctcacaag

SEQ ID NO: 66644 - DNA, 18 bp, synthetic construct
  source 1..18: mol_type = other DNA
ttaagcgactcgatatag

SEQ ID NO: 66645 - DNA, 18 bp, synthetic construct
  source 1..18: mol_type = other DNA
ttaagcgactggctgtgg

SEQ ID NO: 66646 - DNA, 18 bp, synthetic construct
  source 1..18: mol_type = other DNA
ttaatattctatctatag

SEQ ID NO: 66647 - DNA, 18 bp, synthetic construct
  source 1..18: mol_type = other DNA
ttaatcgactcaatacag

SEQ ID NO: 66648 - DNA, 18 bp, synthetic construct
  source 1..18: mol_type = other DNA
ttaatcgattaccaatag

SEQ ID NO: 66649 - DNA, 18 bp, synthetic construct
  source 1..18: mol_type = other DNA
ttaatcgtctgactaaag

SEQ ID NO: 66650 - DNA, 18 bp, synthetic construct
  source 1..18: mol_type = other DNA
ttaatctactgactttag

SEQ ID NO: 66651 - DNA, 18 bp, synthetic construct
  source 1..18: mol_type = other DNA
ttaattgactcattaaag

SEQ ID NO: 66652 - DNA, 18 bp, synthetic construct
  source 1..18: mol_type = other DNA
ttaattgtcacgctaccg

SEQ ID NO: 66653 - DNA, 18 bp, synthetic construct
  source 1..18: mol_type = other DNA
ttacacagcacattatag

SEQ ID NO: 66654 - DNA, 18 bp, synthetic construct
  source 1..18: mol_type = other DNA
ttacaccatacactatag

SEQ ID NO: 66655 - DNA, 18 bp, synthetic construct
  source 1..18: mol_type = other DNA
ttacacgacactgtatcg

SEQ ID NO: 66656 - DNA, 18 bp, synthetic construct
  source 1..18: mol_type = other DNA
ttacacgactcaagacag

SEQ ID NO: 66657 - DNA, 18 bp, synthetic construct
  source 1..18: mol_type = other DNA
ttacacgactcataaaag

SEQ ID NO: 66658 - DNA, 18 bp, synthetic construct
  source 1..18: mol_type = other DNA
ttacacgactctcaattg

SEQ ID NO: 66659 - DNA, 18 bp, synthetic construct
  source 1..18: mol_type = other DNA
ttacacgattaactcttg

SEQ ID NO: 66660 - DNA, 18 bp, synthetic construct
  source 1..18: mol_type = other DNA
ttacacgtctccctattg

SEQ ID NO: 66661 - DNA, 18 bp, synthetic construct
  source 1..18: mol_type = other DNA
ttacactactagctacag

SEQ ID NO: 66662 - DNA, 18 bp, synthetic construct
  source 1..18: mol_type = other DNA
ttacagggctctgtttag

SEQ ID NO: 66663 - DNA, 18 bp, synthetic construct
  source 1..18: mol_type = other DNA
ttacatgacttactctag

SEQ ID NO: 66664 - DNA, 18 bp, synthetic construct
  source 1..18: mol_type = other DNA
ttacctgactccctatag

SEQ ID NO: 66665 - DNA, 18 bp, synthetic construct
  source 1..18: mol_type = other DNA
ttacgcgagttgctatag

SEQ ID NO: 66666 - DNA, 18 bp, synthetic construct
  source 1..18: mol_type = other DNA
ttactcgaatcactcttg

SEQ ID NO: 66667 - DNA, 18 bp, synthetic construct
  source 1..18: mol_type = other DNA
ttactcgatttactatag

SEQ ID NO: 66668 - DNA, 18 bp, synthetic construct
  source 1..18: mol_type = other DNA
ttacttgactcgctatag

SEQ ID NO: 66669 - DNA, 18 bp, synthetic construct
  source 1..18: mol_type = other DNA
ttagacgaaaaactgttg

SEQ ID NO: 66670 - DNA, 18 bp, synthetic construct
  source 1..18: mol_type = other DNA
ttagacgttttactttag

SEQ ID NO: 66671 - DNA, 18 bp, synthetic construct
  source 1..18: mol_type = other DNA
ttagtagactcaatatag

SEQ ID NO: 66672 - DNA, 18 bp, synthetic construct
  source 1..18: mol_type = other DNA
ttagttgacgctttatag

SEQ ID NO: 66673 - DNA, 18 bp, synthetic construct
  source 1..18: mol_type = other DNA
ttataagacatacttaag

SEQ ID NO: 66674 - DNA, 18 bp, synthetic construct
  source 1..18: mol_type = other DNA
ttataagactctccttag

SEQ ID NO: 66675 - DNA, 18 bp, synthetic construct
  source 1..18: mol_type = other DNA
ttataagagacattatag

SEQ ID NO: 66676 - DNA, 18 bp, synthetic construct
  source 1..18: mol_type = other DNA
ttataagagactcaattg

SEQ ID NO: 66677 - DNA, 18 bp, synthetic construct
  source 1..18: mol_type = other DNA
ttataagattctctattg

SEQ ID NO: 66678 - DNA, 18 bp, synthetic construct
  source 1..18: mol_type = other DNA
ttataagcctcactcaag

SEQ ID NO: 66679 - DNA, 18 bp, synthetic construct
  source 1..18: mol_type = other DNA
ttataagtaacattatag

SEQ ID NO: 66680 - DNA, 18 bp, synthetic construct
  source 1..18: mol_type = other DNA
ttataagtctctctagag

SEQ ID NO: 66681 - DNA, 18 bp, synthetic construct
  source 1..18: mol_type = other DNA
ttataatgcacactcgag

SEQ ID NO: 66682 - DNA, 18 bp, synthetic construct
  source 1..18: mol_type = other DNA
ttatacaaatcactgatg

SEQ ID NO: 66683 - DNA, 18 bp, synthetic construct
  source 1..18: mol_type = other DNA
ttatacaaatctatcaag

SEQ ID NO: 66684 - DNA, 18 bp, synthetic construct
  source 1..18: mol_type = other DNA
ttatacaacatacacaag

SEQ ID NO: 66685 - DNA, 18 bp, synthetic construct
  source 1..18: mol_type = other DNA
ttatacaactcacatgag

SEQ ID NO: 66686 - DNA, 18 bp, synthetic construct
  source 1..18: mol_type = other DNA
ttatacaactctctccag

SEQ ID NO: 66687 - DNA, 18 bp, synthetic construct
  source 1..18: mol_type = other DNA
ttatacaacttcttatag

SEQ ID NO: 66688 - DNA, 18 bp, synthetic construct
  source 1..18: mol_type = other DNA
ttatacactacactaagg

SEQ ID NO: 66689 - DNA, 18 bp, synthetic construct
  source 1..18: mol_type = other DNA
ttatacctctcgctatcg

SEQ ID NO: 66690 - DNA, 18 bp, synthetic construct
  source 1..18: mol_type = other DNA
ttatacgaaacagcttag

SEQ ID NO: 66691 - DNA, 18 bp, synthetic construct
  source 1..18: mol_type = other DNA
ttatacgaacctgtattg

SEQ ID NO: 66692 - DNA, 18 bp, synthetic construct
  source 1..18: mol_type = other DNA
ttatacgaagccaactag

SEQ ID NO: 66693 - DNA, 18 bp, synthetic construct
  source 1..18: mol_type = other DNA
ttatacgaatcacagttg

SEQ ID NO: 66694 - DNA, 18 bp, synthetic construct
  source 1..18: mol_type = other DNA
ttatacgacacagtcttg

SEQ ID NO: 66695 - DNA, 18 bp, synthetic construct
  source 1..18: mol_type = other DNA
ttatacgacattcgttcg

SEQ ID NO: 66696 - DNA, 18 bp, synthetic construct
  source 1..18: mol_type = other DNA
ttatacgaccatccctag

SEQ ID NO: 66697 - DNA, 18 bp, synthetic construct
  source 1..18: mol_type = other DNA
ttatacgacgtacttatg

SEQ ID NO: 66698 - DNA, 18 bp, synthetic construct
  source 1..18: mol_type = other DNA
ttatacgactcatattcg

SEQ ID NO: 66699 - DNA, 18 bp, synthetic construct
  source 1..18: mol_type = other DNA
ttatacgactcatttagg

SEQ ID NO: 66700 - DNA, 18 bp, synthetic construct
  source 1..18: mol_type = other DNA
ttatacgactggctctgg

SEQ ID NO: 66701 - DNA, 18 bp, synthetic construct
  source 1..18: mol_type = other DNA
ttatacgactgtaaatag

SEQ ID NO: 66702 - DNA, 18 bp, synthetic construct
  source 1..18: mol_type = other DNA
ttatacgactttaaatag

SEQ ID NO: 66703 - DNA, 18 bp, synthetic construct
  source 1..18: mol_type = other DNA
ttatacgagcctacatag

SEQ ID NO: 66704 - DNA, 18 bp, synthetic construct
  source 1..18: mol_type = other DNA
ttatacgagtcgagatag

SEQ ID NO: 66705 - DNA, 18 bp, synthetic construct
  source 1..18: mol_type = other DNA
ttatacgatacaccttag

SEQ ID NO: 66706 - DNA, 18 bp, synthetic construct
  source 1..18: mol_type = other DNA
ttatacgattcggtctcg

SEQ ID NO: 66707 - DNA, 18 bp, synthetic construct
  source 1..18: mol_type = other DNA
ttatacgattctttttag

SEQ ID NO: 66708 - DNA, 18 bp, synthetic construct
  source 1..18: mol_type = other DNA
ttatacggcaagctagag

SEQ ID NO: 66709 - DNA, 18 bp, synthetic construct
  source 1..18: mol_type = other DNA
ttatacggctccaaaatg

SEQ ID NO: 66710 - DNA, 18 bp, synthetic construct
  source 1..18: mol_type = other DNA
ttatacgtcagtatatgg

SEQ ID NO: 66711 - DNA, 18 bp, synthetic construct
  source 1..18: mol_type = other DNA
ttatacgtctagctatgg

SEQ ID NO: 66712 - DNA, 18 bp, synthetic construct
  source 1..18: mol_type = other DNA
ttatacgtctcataattg

SEQ ID NO: 66713 - DNA, 18 bp, synthetic construct
  source 1..18: mol_type = other DNA
ttatacgtctcatattag

SEQ ID NO: 66714 - DNA, 18 bp, synthetic construct
  source 1..18: mol_type = other DNA
ttatacgtctgacactag

SEQ ID NO: 66715 - DNA, 18 bp, synthetic construct
  source 1..18: mol_type = other DNA
ttatacgtttcagtagag

SEQ ID NO: 66716 - DNA, 18 bp, synthetic construct
  source 1..18: mol_type = other DNA
ttatacgtttcgctctag

SEQ ID NO: 66717 - DNA, 18 bp, synthetic construct
  source 1..18: mol_type = other DNA
ttatacgtttctctttag

SEQ ID NO: 66718 - DNA, 18 bp, synthetic construct
  source 1..18: mol_type = other DNA
ttatactactcttaatag

SEQ ID NO: 66719 - DNA, 18 bp, synthetic construct
  source 1..18: mol_type = other DNA
ttatactatcaagtattg

SEQ ID NO: 66720 - DNA, 18 bp, synthetic construct
  source 1..18: mol_type = other DNA
ttatactgcacccaaagg

SEQ ID NO: 66721 - DNA, 18 bp, synthetic construct
  source 1..18: mol_type = other DNA
ttatacttcccacgagag

SEQ ID NO: 66722 - DNA, 18 bp, synthetic construct
  source 1..18: mol_type = other DNA
ttatacttctcacttcag

SEQ ID NO: 66723 - DNA, 18 bp, synthetic construct
  source 1..18: mol_type = other DNA
ttatagaacactctatag

SEQ ID NO: 66724 - DNA, 18 bp, synthetic construct
  source 1..18: mol_type = other DNA
ttatagatctcacactag

SEQ ID NO: 66725 - DNA, 18 bp, synthetic construct
  source 1..18: mol_type = other DNA
ttatagcactcaataaag

SEQ ID NO: 66726 - DNA, 18 bp, synthetic construct
  source 1..18: mol_type = other DNA
ttataggagttactaaag

SEQ ID NO: 66727 - DNA, 18 bp, synthetic construct
  source 1..18: mol_type = other DNA
ttataggtcattcaatag

SEQ ID NO: 66728 - DNA, 18 bp, synthetic construct
  source 1..18: mol_type = other DNA
ttataggtctcacagttg

SEQ ID NO: 66729 - DNA, 18 bp, synthetic construct
  source 1..18: mol_type = other DNA
ttataggtctccgtttag

SEQ ID NO: 66730 - DNA, 18 bp, synthetic construct
  source 1..18: mol_type = other DNA
ttataggtctctcttttg

SEQ ID NO: 66731 - DNA, 18 bp, synthetic construct
  source 1..18: mol_type = other DNA
ttatataacgcacattag

SEQ ID NO: 66732 - DNA, 18 bp, synthetic construct
  source 1..18: mol_type = other DNA
ttatataacttactaaag

SEQ ID NO: 66733 - DNA, 18 bp, synthetic construct
  source 1..18: mol_type = other DNA
ttatatcgatctgtatcg

SEQ ID NO: 66734 - DNA, 18 bp, synthetic construct
  source 1..18: mol_type = other DNA
ttatatgaatcattagag

SEQ ID NO: 66735 - DNA, 18 bp, synthetic construct
  source 1..18: mol_type = other DNA
ttatatgaatcattcaag

SEQ ID NO: 66736 - DNA, 18 bp, synthetic construct
  source 1..18: mol_type = other DNA
ttatatgacgcccttaag

SEQ ID NO: 66737 - DNA, 18 bp, synthetic construct
  source 1..18: mol_type = other DNA
ttatatgactcatttttg

SEQ ID NO: 66738 - DNA, 18 bp, synthetic construct
  source 1..18: mol_type = other DNA
ttatatgactctatttag

SEQ ID NO: 66739 - DNA, 18 bp, synthetic construct
  source 1..18: mol_type = other DNA
ttatatgacttgctttag

SEQ ID NO: 66740 - DNA, 18 bp, synthetic construct
  source 1..18: mol_type = other DNA
ttatatgattcgctaagg

SEQ ID NO: 66741 - DNA, 18 bp, synthetic construct
  source 1..18: mol_type = other DNA
ttatatgccatactatag

SEQ ID NO: 66742 - DNA, 18 bp, synthetic construct
  source 1..18: mol_type = other DNA
ttatatgtctgtctaaag

SEQ ID NO: 66743 - DNA, 18 bp, synthetic construct
  source 1..18: mol_type = other DNA
ttatatgtcttgctttag

SEQ ID NO: 66744 - DNA, 18 bp, synthetic construct
  source 1..18: mol_type = other DNA
ttatattactcagtaaag

SEQ ID NO: 66745 - DNA, 18 bp, synthetic construct
  source 1..18: mol_type = other DNA
ttatattactctatatag

SEQ ID NO: 66746 - DNA, 18 bp, synthetic construct
  source 1..18: mol_type = other DNA
ttatcagatctagtattg

SEQ ID NO: 66747 - DNA, 18 bp, synthetic construct
  source 1..18: mol_type = other DNA
ttatccaacatacttctg

SEQ ID NO: 66748 - DNA, 18 bp, synthetic construct
  source 1..18: mol_type = other DNA
ttatccgaccctgtatag

SEQ ID NO: 66749 - DNA, 18 bp, synthetic construct
  source 1..18: mol_type = other DNA
ttatccgactgacaatcg

SEQ ID NO: 66750 - DNA, 18 bp, synthetic construct
  source 1..18: mol_type = other DNA
ttatcctattcactaaag

SEQ ID NO: 66751 - DNA, 18 bp, synthetic construct
  source 1..18: mol_type = other DNA
ttatcggtcacactatag

SEQ ID NO: 66752 - DNA, 18 bp, synthetic construct
  source 1..18: mol_type = other DNA
ttatctaactcactacag

SEQ ID NO: 66753 - DNA, 18 bp, synthetic construct
  source 1..18: mol_type = other DNA
ttatgagactgacaaaag

SEQ ID NO: 66754 - DNA, 18 bp, synthetic construct
  source 1..18: mol_type = other DNA
ttatgcaactcactaatg

SEQ ID NO: 66755 - DNA, 18 bp, synthetic construct
  source 1..18: mol_type = other DNA
ttatgcaacttattatag

SEQ ID NO: 66756 - DNA, 18 bp, synthetic construct
  source 1..18: mol_type = other DNA
ttatgcgactcatcatcg

SEQ ID NO: 66757 - DNA, 18 bp, synthetic construct
  source 1..18: mol_type = other DNA
ttatgcgaggcactgtag

SEQ ID NO: 66758 - DNA, 18 bp, synthetic construct
  source 1..18: mol_type = other DNA
ttatgcgattcacaattg

SEQ ID NO: 66759 - DNA, 18 bp, synthetic construct
  source 1..18: mol_type = other DNA
ttatgcgtctcactgaag

SEQ ID NO: 66760 - DNA, 18 bp, synthetic construct
  source 1..18: mol_type = other DNA
ttatgcgtctctctaaag

SEQ ID NO: 66761 - DNA, 18 bp, synthetic construct
  source 1..18: mol_type = other DNA
ttattagatacgttaaag

SEQ ID NO: 66762 - DNA, 18 bp, synthetic construct
  source 1..18: mol_type = other DNA
ttattagattcactttag

SEQ ID NO: 66763 - DNA, 18 bp, synthetic construct
  source 1..18: mol_type = other DNA
ttattattctcactatag

SEQ ID NO: 66764 - DNA, 18 bp, synthetic construct
  source 1..18: mol_type = other DNA
ttattcaacacactaaag

SEQ ID NO: 66765 - DNA, 18 bp, synthetic construct
  source 1..18: mol_type = other DNA
ttattcaactcccaatag

SEQ ID NO: 66766 - DNA, 18 bp, synthetic construct
  source 1..18: mol_type = other DNA
ttattccactcataacag

SEQ ID NO: 66767 - DNA, 18 bp, synthetic construct
  source 1..18: mol_type = other DNA
ttattccagtaactttag

SEQ ID NO: 66768 - DNA, 18 bp, synthetic construct
  source 1..18: mol_type = other DNA
ttattcgacacattttag

SEQ ID NO: 66769 - DNA, 18 bp, synthetic construct
  source 1..18: mol_type = other DNA
ttattcgactaactaatg

SEQ ID NO: 66770 - DNA, 18 bp, synthetic construct
  source 1..18: mol_type = other DNA
ttattcgacttaatttag

SEQ ID NO: 66771 - DNA, 18 bp, synthetic construct
  source 1..18: mol_type = other DNA
ttattcgacttgacattg

SEQ ID NO: 66772 - DNA, 18 bp, synthetic construct
  source 1..18: mol_type = other DNA
ttattcgagacactaaag

SEQ ID NO: 66773 - DNA, 18 bp, synthetic construct
  source 1..18: mol_type = other DNA
ttattcgccacactattg

SEQ ID NO: 66774 - DNA, 18 bp, synthetic construct
  source 1..18: mol_type = other DNA
ttattcggtacacttctg

SEQ ID NO: 66775 - DNA, 18 bp, synthetic construct
  source 1..18: mol_type = other DNA
ttattcgtaccactttag

SEQ ID NO: 66776 - DNA, 18 bp, synthetic construct
  source 1..18: mol_type = other DNA
ttattctactctctttag

SEQ ID NO: 66777 - DNA, 18 bp, synthetic construct
  source 1..18: mol_type = other DNA
ttattctgcacactaaag

SEQ ID NO: 66778 - DNA, 18 bp, synthetic construct
  source 1..18: mol_type = other DNA
ttattcttctcacaatag

SEQ ID NO: 66779 - DNA, 18 bp, synthetic construct
  source 1..18: mol_type = other DNA
ttattcttttcacaacag

SEQ ID NO: 66780 - DNA, 18 bp, synthetic construct
  source 1..18: mol_type = other DNA
ttattggactgactaatg

SEQ ID NO: 66781 - DNA, 18 bp, synthetic construct
  source 1..18: mol_type = other DNA
ttattggtctcactaaag

SEQ ID NO: 66782 - DNA, 18 bp, synthetic construct
  source 1..18: mol_type = other DNA
ttatttcactcaatattg

SEQ ID NO: 66783 - DNA, 18 bp, synthetic construct
  source 1..18: mol_type = other DNA
ttatttgaataactatag

SEQ ID NO: 66784 - DNA, 18 bp, synthetic construct
  source 1..18: mol_type = other DNA
ttatttgtctcactatcg

SEQ ID NO: 66785 - DNA, 18 bp, synthetic construct
  source 1..18: mol_type = other DNA
ttattttaatctcattag

SEQ ID NO: 66786 - DNA, 18 bp, synthetic construct
  source 1..18: mol_type = other DNA
ttcaaagactctctatag

SEQ ID NO: 66787 - DNA, 18 bp, synthetic construct
  source 1..18: mol_type = other DNA
ttccacgagacactacag

SEQ ID NO: 66788 - DNA, 18 bp, synthetic construct
  source 1..18: mol_type = other DNA
ttctaaggcatacaagcg

SEQ ID NO: 66789 - DNA, 18 bp, synthetic construct
  source 1..18: mol_type = other DNA
ttctacgtcttactattg

SEQ ID NO: 66790 - DNA, 18 bp, synthetic construct
  source 1..18: mol_type = other DNA
ttctatatctcacttttg

SEQ ID NO: 66791 - DNA, 18 bp, synthetic construct
  source 1..18: mol_type = other DNA
ttctatgattctttagag

SEQ ID NO: 66792 - DNA, 18 bp, synthetic construct
  source 1..18: mol_type = other DNA
ttctattactaagtatag

SEQ ID NO: 66793 - DNA, 18 bp, synthetic construct
  source 1..18: mol_type = other DNA
ttctcagacacatcttag

SEQ ID NO: 66794 - DNA, 18 bp, synthetic construct
  source 1..18: mol_type = other DNA
ttctgcgacattcaaccg

SEQ ID NO: 66795 - DNA, 18 bp, synthetic construct
  source 1..18: mol_type = other DNA
ttcttcaactcactacag

SEQ ID NO: 66796 - DNA, 18 bp, synthetic construct
  source 1..18: mol_type = other DNA
ttgaaacatttacatttg

SEQ ID NO: 66797 - DNA, 18 bp, synthetic construct
  source 1..18: mol_type = other DNA
ttgaacaactctcaatag

SEQ ID NO: 66798 - DNA, 18 bp, synthetic construct
  source 1..18: mol_type = other DNA
ttgaacgactagctatag

SEQ ID NO: 66799 - DNA, 18 bp, synthetic construct
  source 1..18: mol_type = other DNA
ttgaacgtctcacagtag

SEQ ID NO: 66800 - DNA, 18 bp, synthetic construct
  source 1..18: mol_type = other DNA
ttgagctactgaataaag

SEQ ID NO: 66801 - DNA, 18 bp, synthetic construct
  source 1..18: mol_type = other DNA
ttgattgactctctattg

SEQ ID NO: 66802 - DNA, 18 bp, synthetic construct
  source 1..18: mol_type = other DNA
ttgctctactcactaaag

SEQ ID NO: 66803 - DNA, 18 bp, synthetic construct
  source 1..18: mol_type = other DNA
ttggaagacttactattg

SEQ ID NO: 66804 - DNA, 18 bp, synthetic construct
  source 1..18: mol_type = other DNA
ttgtaacaatcattccag

SEQ ID NO: 66805 - DNA, 18 bp, synthetic construct
  source 1..18: mol_type = other DNA
ttgtaagactctctaaag

SEQ ID NO: 66806 - DNA, 18 bp, synthetic construct
  source 1..18: mol_type = other DNA
ttgtacgactaacagtag

SEQ ID NO: 66807 - DNA, 18 bp, synthetic construct
  source 1..18: mol_type = other DNA
ttgtacgtctcattattg

SEQ ID NO: 66808 - DNA, 18 bp, synthetic construct
  source 1..18: mol_type = other DNA
ttgtactactaacgtttg

SEQ ID NO: 66809 - DNA, 18 bp, synthetic construct
  source 1..18: mol_type = other DNA
ttgtaggagtgactttag

SEQ ID NO: 66810 - DNA, 18 bp, synthetic construct
  source 1..18: mol_type = other DNA
ttgtccgtataactgaag

SEQ ID NO: 66811 - DNA, 18 bp, synthetic construct
  source 1..18: mol_type = other DNA
ttgttcgactcacttatg

SEQ ID NO: 66812 - DNA, 18 bp, synthetic construct
  source 1..18: mol_type = other DNA
ttgttcgagtcgctatag

SEQ ID NO: 66813 - DNA, 18 bp, synthetic construct
  source 1..18: mol_type = other DNA
ttgttcgtcttactacag

SEQ ID NO: 66814 - DNA, 18 bp, synthetic construct
  source 1..18: mol_type = other DNA
tttaaagacacactatag

SEQ ID NO: 66815 - DNA, 18 bp, synthetic construct
  source 1..18: mol_type = other DNA
tttaaagactcactattg

SEQ ID NO: 66816 - DNA, 18 bp, synthetic construct
  source 1..18: mol_type = other DNA
tttaacaactgattatag

SEQ ID NO: 66817 - DNA, 18 bp, synthetic construct
  source 1..18: mol_type = other DNA
tttaacgaatcaatattg

SEQ ID NO: 66818 - DNA, 18 bp, synthetic construct
  source 1..18: mol_type = other DNA
tttaacgactcaccattg

SEQ ID NO: 66819 - DNA, 18 bp, synthetic construct
  source 1..18: mol_type = other DNA
tttaacgactgactattg

SEQ ID NO: 66820 - DNA, 18 bp, synthetic construct
  source 1..18: mol_type = other DNA
tttaacggctcataaggg

SEQ ID NO: 66821 - DNA, 18 bp, synthetic construct
  source 1..18: mol_type = other DNA
tttaacgtttcactatag

SEQ ID NO: 66822 - DNA, 18 bp, synthetic construct
  source 1..18: mol_type = other DNA
tttaactacacactatag

SEQ ID NO: 66823 - DNA, 18 bp, synthetic construct
  source 1..18: mol_type = other DNA
tttaaggattcacaatag

SEQ ID NO: 66824 - DNA, 18 bp, synthetic construct
  source 1..18: mol_type = other DNA
tttaaggattcattatag

SEQ ID NO: 66825 - DNA, 18 bp, synthetic construct
  source 1..18: mol_type = other DNA
tttaccgattcaccatag

SEQ ID NO: 66826 - DNA, 18 bp, synthetic construct
  source 1..18: mol_type = other DNA
tttatcgacttaaaacag

SEQ ID NO: 66827 - DNA, 18 bp, synthetic construct
  source 1..18: mol_type = other DNA
tttatcgatacactattg

SEQ ID NO: 66828 - DNA, 18 bp, synthetic construct
  source 1..18: mol_type = other DNA
tttcacgacacactgtag

SEQ ID NO: 66829 - DNA, 18 bp, synthetic construct
  source 1..18: mol_type = other DNA
tttcacgacttaccatag

SEQ ID NO: 66830 - DNA, 18 bp, synthetic construct
  source 1..18: mol_type = other DNA
tttcacgtatcattatag

SEQ ID NO: 66831 - DNA, 18 bp, synthetic construct
  source 1..18: mol_type = other DNA
tttctcgactcattatag

SEQ ID NO: 66832 - DNA, 18 bp, synthetic construct
  source 1..18: mol_type = other DNA
tttgatgtctcactatag

SEQ ID NO: 66833 - DNA, 18 bp, synthetic construct
  source 1..18: mol_type = other DNA
tttggaacctccccctgg

SEQ ID NO: 66834 - DNA, 18 bp, synthetic construct
  source 1..18: mol_type = other DNA
ttttaacacattctaaag

SEQ ID NO: 66835 - DNA, 18 bp, synthetic construct
  source 1..18: mol_type = other DNA
ttttaacactcactatcg

SEQ ID NO: 66836 - DNA, 18 bp, synthetic construct
  source 1..18: mol_type = other DNA
ttttaagactccctatgg

SEQ ID NO: 66837 - DNA, 18 bp, synthetic construct
  source 1..18: mol_type = other DNA
ttttaatactccctagag

SEQ ID NO: 66838 - DNA, 18 bp, synthetic construct
  source 1..18: mol_type = other DNA
ttttacaacacacttttg

SEQ ID NO: 66839 - DNA, 18 bp, synthetic construct
  source 1..18: mol_type = other DNA
ttttacaactccagttag

SEQ ID NO: 66840 - DNA, 18 bp, synthetic construct
  source 1..18: mol_type = other DNA
ttttacaattcactaagg

SEQ ID NO: 66841 - DNA, 18 bp, synthetic construct
  source 1..18: mol_type = other DNA
ttttacgaataattttag

SEQ ID NO: 66842 - DNA, 18 bp, synthetic construct
  source 1..18: mol_type = other DNA
ttttacgacacaatttag

SEQ ID NO: 66843 - DNA, 18 bp, synthetic construct
  source 1..18: mol_type = other DNA
ttttacgacactctatgg

SEQ ID NO: 66844 - DNA, 18 bp, synthetic construct
  source 1..18: mol_type = other DNA
ttttacgactcacttacg

SEQ ID NO: 66845 - DNA, 18 bp, synthetic construct
  source 1..18: mol_type = other DNA
ttttacgagtcatagtgg

SEQ ID NO: 66846 - DNA, 18 bp, synthetic construct
  source 1..18: mol_type = other DNA
ttttacgcctgactattg

SEQ ID NO: 66847 - DNA, 18 bp, synthetic construct
  source 1..18: mol_type = other DNA
ttttacggcttcctctag

SEQ ID NO: 66848 - DNA, 18 bp, synthetic construct
  source 1..18: mol_type = other DNA
ttttacgtctcaataaag

SEQ ID NO: 66849 - DNA, 18 bp, synthetic construct
  source 1..18: mol_type = other DNA
ttttactaaacacttaag

SEQ ID NO: 66850 - DNA, 18 bp, synthetic construct
  source 1..18: mol_type = other DNA
ttttactactcgctaaag

SEQ ID NO: 66851 - DNA, 18 bp, synthetic construct
  source 1..18: mol_type = other DNA
ttttactactttctatag

SEQ ID NO: 66852 - DNA, 18 bp, synthetic construct
  source 1..18: mol_type = other DNA
ttttagtattgacaatag

SEQ ID NO: 66853 - DNA, 18 bp, synthetic construct
  source 1..18: mol_type = other DNA
ttttagtgataattatag

SEQ ID NO: 66854 - DNA, 18 bp, synthetic construct
  source 1..18: mol_type = other DNA
ttttatgatacactattg

SEQ ID NO: 66855 - DNA, 18 bp, synthetic construct
  source 1..18: mol_type = other DNA
ttttattattcactatag

SEQ ID NO: 66856 - DNA, 18 bp, synthetic construct
  source 1..18: mol_type = other DNA
ttttcagactcactctag

SEQ ID NO: 66857 - DNA, 18 bp, synthetic construct
  source 1..18: mol_type = other DNA
ttttccgactcagtcttg

SEQ ID NO: 66858 - DNA, 18 bp, synthetic construct
  source 1..18: mol_type = other DNA
ttttccgtctcactttag

SEQ ID NO: 66859 - DNA, 18 bp, synthetic construct
  source 1..18: mol_type = other DNA
ttttctcactctctatag

SEQ ID NO: 66860 - DNA, 18 bp, synthetic construct
  source 1..18: mol_type = other DNA
ttttcttactgtcaatag

SEQ ID NO: 66861 - DNA, 18 bp, synthetic construct
  source 1..18: mol_type = other DNA
tttttcatcttactttag

SEQ ID NO: 66862 - DNA, 18 bp, synthetic construct
  source 1..18: mol_type = other DNA
tttttccaatcgctatag

SEQ ID NO: 66863 - DNA, 18 bp, synthetic construct
  source 1..18: mol_type = other DNA
tttttcgactctctctgg

SEQ ID NO: 66864 - DNA, 18 bp, synthetic construct
  source 1..18: mol_type = other DNA
tttttctactcgctatag

SEQ ID NO: 66865 - DNA, 18 bp, synthetic construct
  source 1..18: mol_type = other DNA
aaatacgactttcttaag

SEQ ID NO: 66866 - DNA, 18 bp, synthetic construct
  source 1..18: mol_type = other DNA
aaatacgaattacttaag

SEQ ID NO: 66867 - DNA, 18 bp, synthetic construct
  source 1..18: mol_type = other DNA
aacaacgactaactattg

SEQ ID NO: 66868 - DNA, 18 bp, synthetic construct
  source 1..18: mol_type = other DNA
aactatgagtcattcaag

SEQ ID NO: 66869 - DNA, 18 bp, synthetic construct
  source 1..18: mol_type = other DNA
aataacgtctctgtatag

SEQ ID NO: 66870 - DNA, 18 bp, synthetic construct
  source 1..18: mol_type = other DNA
atatactacacactttag

SEQ ID NO: 66871 - DNA, 18 bp, synthetic construct
  source 1..18: mol_type = other DNA
atctaactctcactatgg

SEQ ID NO: 66872 - DNA, 18 bp, synthetic construct
  source 1..18: mol_type = other DNA
atctcctactcactatag

SEQ ID NO: 66873 - DNA, 18 bp, synthetic construct
  source 1..18: mol_type = other DNA
caaatcgacactctattg

SEQ ID NO: 66874 - DNA, 18 bp, synthetic construct
  source 1..18: mol_type = other DNA
ctattagactcactttag

SEQ ID NO: 66875 - DNA, 18 bp, synthetic construct
  source 1..18: mol_type = other DNA
taaaacgtcacactttcg

SEQ ID NO: 66876 - DNA, 18 bp, synthetic construct
  source 1..18: mol_type = other DNA
taataagtcacattaaag

SEQ ID NO: 66877 - DNA, 18 bp, synthetic construct
  source 1..18: mol_type = other DNA
taatacaagttaatttag

SEQ ID NO: 66878 - DNA, 18 bp, synthetic construct
  source 1..18: mol_type = other DNA
taatactaaaccctattg

SEQ ID NO: 66879 - DNA, 18 bp, synthetic construct
  source 1..18: mol_type = other DNA
taatccgactcttaattg

SEQ ID NO: 66880 - DNA, 18 bp, synthetic construct
  source 1..18: mol_type = other DNA
taatgcgattctatattg

SEQ ID NO: 66881 - DNA, 18 bp, synthetic construct
  source 1..18: mol_type = other DNA
taattcgaataaccattg

SEQ ID NO: 66882 - DNA, 18 bp, synthetic construct
  source 1..18: mol_type = other DNA
tatatcgactcacaaaag

SEQ ID NO: 66883 - DNA, 18 bp, synthetic construct
  source 1..18: mol_type = other DNA
tatatcgttactcgattg

SEQ ID NO: 66884 - DNA, 18 bp, synthetic construct
  source 1..18: mol_type = other DNA
tattacatctaactttag

SEQ ID NO: 66885 - DNA, 18 bp, synthetic construct
  source 1..18: mol_type = other DNA
tattacgacttacaaacg

SEQ ID NO: 66886 - DNA, 18 bp, synthetic construct
  source 1..18: mol_type = other DNA
tattccgactttctattg

SEQ ID NO: 66887 - DNA, 18 bp, synthetic construct
  source 1..18: mol_type = other DNA
tatttcgacacgctaaag

SEQ ID NO: 66888 - DNA, 18 bp, synthetic construct
  source 1..18: mol_type = other DNA
tatttcgactcaataatg

SEQ ID NO: 66889 - DNA, 18 bp, synthetic construct
  source 1..18: mol_type = other DNA
tattttgactcacaaaag

SEQ ID NO: 66890 - DNA, 18 bp, synthetic construct
  source 1..18: mol_type = other DNA
tcaacccactcacaatag

SEQ ID NO: 66891 - DNA, 18 bp, synthetic construct
  source 1..18: mol_type = other DNA
tcaatcgacccactattg

SEQ ID NO: 66892 - DNA, 18 bp, synthetic construct
  source 1..18: mol_type = other DNA
tcgttcaactcactttag

SEQ ID NO: 66893 - DNA, 18 bp, synthetic construct
  source 1..18: mol_type = other DNA
ttacacgtctctctattg

SEQ ID NO: 66894 - DNA, 18 bp, synthetic construct
  source 1..18: mol_type = other DNA
ttatacgattatctttag

SEQ ID NO: 66895 - DNA, 18 bp, synthetic construct
  source 1..18: mol_type = other DNA
ttattagcctctctatag

SEQ ID NO: 66896 - DNA, 18 bp, synthetic construct
  source 1..18: mol_type = other DNA
tataacatctctctatag

SEQ ID NO: 66897 - DNA, 18 bp, synthetic construct
  source 1..18: mol_type = other DNA
tattacgtctcacatttg

SEQ ID NO: 66898 - DNA, 18 bp, synthetic construct
  source 1..18: mol_type = other DNA
aaaaacgacactcaatag

SEQ ID NO: 66899 - DNA, 18 bp, synthetic construct
  source 1..18: mol_type = other DNA
aaaaacgacccaccttag

SEQ ID NO: 66900 - DNA, 18 bp, synthetic construct
  source 1..18: mol_type = other DNA
aaatacatctcattattg

SEQ ID NO: 66901 - DNA, 18 bp, synthetic construct
  source 1..18: mol_type = other DNA
aaatacatctctctattg

SEQ ID NO: 66902 - DNA, 18 bp, synthetic construct
  source 1..18: mol_type = other DNA
aaattcgacgcactactg

SEQ ID NO: 66903 - DNA, 18 bp, synthetic construct
  source 1..18: mol_type = other DNA
aagaatgtctcactaaag

SEQ ID NO: 66904 - DNA, 18 bp, synthetic construct
  source 1..18: mol_type = other DNA
aattacgattcacttaag

SEQ ID NO: 66905 - DNA, 18 bp, synthetic construct
  source 1..18: mol_type = other DNA
agaaacgactcaccacag

SEQ ID NO: 66906 - DNA, 18 bp, synthetic construct
  source 1..18: mol_type = other DNA
ataaacgccttactagag

SEQ ID NO: 66907 - DNA, 18 bp, synthetic construct
  source 1..18: mol_type = other DNA
ctatattacttacaatag

SEQ ID NO: 66908 - DNA, 18 bp, synthetic construct
  source 1..18: mol_type = other DNA
taaaaccattcactttcg

SEQ ID NO: 66909 - DNA, 18 bp, synthetic construct
  source 1..18: mol_type = other DNA
taaattgactctcaatag

SEQ ID NO: 66910 - DNA, 18 bp, synthetic construct
  source 1..18: mol_type = other DNA
taacacatctcgttttag

SEQ ID NO: 66911 - DNA, 18 bp, synthetic construct
  source 1..18: mol_type = other DNA
taatacaactaacttatg

SEQ ID NO: 66912 - DNA, 18 bp, synthetic construct
  source 1..18: mol_type = other DNA
taatacgaaacattaatg

SEQ ID NO: 66913 - DNA, 18 bp, synthetic construct
  source 1..18: mol_type = other DNA
taatacgtttcacttagg

SEQ ID NO: 66914 - DNA, 18 bp, synthetic construct
  source 1..18: mol_type = other DNA
taatatgaataacattag

SEQ ID NO: 66915 - DNA, 18 bp, synthetic construct
  source 1..18: mol_type = other DNA
tactacatctcacaattg

SEQ ID NO: 66916 - DNA, 18 bp, synthetic construct
  source 1..18: mol_type = other DNA
tagtacaactcacaaaaa

SEQ ID NO: 66917 - DNA, 18 bp, synthetic construct
  source 1..18: mol_type = other DNA
tataacgacacaacatag

SEQ ID NO: 66918 - DNA, 18 bp, synthetic construct
  source 1..18: mol_type = other DNA
tataacgtctaactattg

SEQ ID NO: 66919 - DNA, 18 bp, synthetic construct
  source 1..18: mol_type = other DNA
tataacgtttctctatag

SEQ ID NO: 66920 - DNA, 18 bp, synthetic construct
  source 1..18: mol_type = other DNA
tatcatggctcactattg

SEQ ID NO: 66921 - DNA, 18 bp, synthetic construct
  source 1..18: mol_type = other DNA
tattacctctctttatag

SEQ ID NO: 66922 - DNA, 18 bp, synthetic construct
  source 1..18: mol_type = other DNA
tattacgactaacctttg

SEQ ID NO: 66923 - DNA, 18 bp, synthetic construct
  source 1..18: mol_type = other DNA
tattccgactcgcttttg

SEQ ID NO: 66924 - DNA, 18 bp, synthetic construct
  source 1..18: mol_type = other DNA
tatttcgacacactcttg

SEQ ID NO: 66925 - DNA, 18 bp, synthetic construct
  source 1..18: mol_type = other DNA
tatttcgtctcacttcag

SEQ ID NO: 66926 - DNA, 18 bp, synthetic construct
  source 1..18: mol_type = other DNA
tattttgactctccatag

SEQ ID NO: 66927 - DNA, 18 bp, synthetic construct
  source 1..18: mol_type = other DNA
tcatccgactttcactag

SEQ ID NO: 66928 - DNA, 18 bp, synthetic construct
  source 1..18: mol_type = other DNA
tgacacaactcaaaagag

SEQ ID NO: 66929 - DNA, 18 bp, synthetic construct
  source 1..18: mol_type = other DNA
ttaaaagactcacaaaag

SEQ ID NO: 66930 - DNA, 18 bp, synthetic construct
  source 1..18: mol_type = other DNA
ttaaacgactctcaattg

SEQ ID NO: 66931 - DNA, 18 bp, synthetic construct
  source 1..18: mol_type = other DNA
ttaaacgattggctatag

SEQ ID NO: 66932 - DNA, 18 bp, synthetic construct
  source 1..18: mol_type = other DNA
ttacacgattctctttag

SEQ ID NO: 66933 - DNA, 18 bp, synthetic construct
  source 1..18: mol_type = other DNA
ttatacgcattacaatag

SEQ ID NO: 66934 - DNA, 18 bp, synthetic construct
  source 1..18: mol_type = other DNA
ttatataaatctctatag

SEQ ID NO: 66935 - DNA, 18 bp, synthetic construct
  source 1..18: mol_type = other DNA
ttatcggactctctaaag

SEQ ID NO: 66936 - DNA, 18 bp, synthetic construct
  source 1..18: mol_type = other DNA
ttattagactcataatag

SEQ ID NO: 66937 - DNA, 18 bp, synthetic construct
  source 1..18: mol_type = other DNA
ttattcgtcccacaatag

SEQ ID NO: 66938 - DNA, 18 bp, synthetic construct
  source 1..18: mol_type = other DNA
ttccacttctcactatag

SEQ ID NO: 66939 - DNA, 18 bp, synthetic construct
  source 1..18: mol_type = other DNA
ttttaagactcacaattg

SEQ ID NO: 66940 - DNA, 18 bp, synthetic construct
  source 1..18: mol_type = other DNA
aaaaaacgccctctaaag

SEQ ID NO: 66941 - DNA, 18 bp, synthetic construct
  source 1..18: mol_type = other DNA
aaaaaattctcactgtag

SEQ ID NO: 66942 - DNA, 18 bp, synthetic construct
  source 1..18: mol_type = other DNA
aaaaacaaatccctaccg

SEQ ID NO: 66943 - DNA, 18 bp, synthetic construct
  source 1..18: mol_type = other DNA
aaaaaccaaacacttaag

SEQ ID NO: 66944 - DNA, 18 bp, synthetic construct
  source 1..18: mol_type = other DNA
aaaaacgaatcattatgg

SEQ ID NO: 66945 - DNA, 18 bp, synthetic construct
  source 1..18: mol_type = other DNA
aaaaacgagtcaaaatag

SEQ ID NO: 66946 - DNA, 18 bp, synthetic construct
  source 1..18: mol_type = other DNA
aaaaacgtacctttacag

SEQ ID NO: 66947 - DNA, 18 bp, synthetic construct
  source 1..18: mol_type = other DNA
aaaaactactaaccatag

SEQ ID NO: 66948 - DNA, 18 bp, synthetic construct
  source 1..18: mol_type = other DNA
aaaaactactcacaaaag

SEQ ID NO: 66949 - DNA, 18 bp, synthetic construct
  source 1..18: mol_type = other DNA
aaaaactactcacattag

SEQ ID NO: 66950 - DNA, 18 bp, synthetic construct
  source 1..18: mol_type = other DNA
aaaaaggacttgctttag

SEQ ID NO: 66951 - DNA, 18 bp, synthetic construct
  source 1..18: mol_type = other DNA
aaaaagggctctccttag

SEQ ID NO: 66952 - DNA, 18 bp, synthetic construct
  source 1..18: mol_type = other DNA
aaaaattactgtctatag

SEQ ID NO: 66953 - DNA, 18 bp, synthetic construct
  source 1..18: mol_type = other DNA
aaaaccggcacgatatag

SEQ ID NO: 66954 - DNA, 18 bp, synthetic construct
  source 1..18: mol_type = other DNA
aaaacctatttacatttg

SEQ ID NO: 66955 - DNA, 18 bp, synthetic construct
  source 1..18: mol_type = other DNA
aaaagcgacacaatatag

SEQ ID NO: 66956 - DNA, 18 bp, synthetic construct
  source 1..18: mol_type = other DNA
aaaagggacacccttttg

SEQ ID NO: 66957 - DNA, 18 bp, synthetic construct
  source 1..18: mol_type = other DNA
aaaataaactcactattg

SEQ ID NO: 66958 - DNA, 18 bp, synthetic construct
  source 1..18: mol_type = other DNA
aaaatggactcactatcg

SEQ ID NO: 66959 - DNA, 18 bp, synthetic construct
  source 1..18: mol_type = other DNA
aaacacgagtctttatag

SEQ ID NO: 66960 - DNA, 18 bp, synthetic construct
  source 1..18: mol_type = other DNA
aaactagactcgctttag

SEQ ID NO: 66961 - DNA, 18 bp, synthetic construct
  source 1..18: mol_type = other DNA
aaactcgtttctctatag

SEQ ID NO: 66962 - DNA, 18 bp, synthetic construct
  source 1..18: mol_type = other DNA
aaagacccctgtctaaag

SEQ ID NO: 66963 - DNA, 18 bp, synthetic construct
  source 1..18: mol_type = other DNA
aaagcatactcaatacag

SEQ ID NO: 66964 - DNA, 18 bp, synthetic construct
  source 1..18: mol_type = other DNA
aaataacacacacttttg

SEQ ID NO: 66965 - DNA, 18 bp, synthetic construct
  source 1..18: mol_type = other DNA
aaataagactatctattg

SEQ ID NO: 66966 - DNA, 18 bp, synthetic construct
  source 1..18: mol_type = other DNA
aaataaggatctcctttg

SEQ ID NO: 66967 - DNA, 18 bp, synthetic construct
  source 1..18: mol_type = other DNA
aaataatactcacaattg

SEQ ID NO: 66968 - DNA, 18 bp, synthetic construct
  source 1..18: mol_type = other DNA
aaatacatttcactttag

SEQ ID NO: 66969 - DNA, 18 bp, synthetic construct
  source 1..18: mol_type = other DNA
aaataccacttactcttg

SEQ ID NO: 66970 - DNA, 18 bp, synthetic construct
  source 1..18: mol_type = other DNA
aaataccattcaccacgg

SEQ ID NO: 66971 - DNA, 18 bp, synthetic construct
  source 1..18: mol_type = other DNA
aaatacctctgacaaaag

SEQ ID NO: 66972 - DNA, 18 bp, synthetic construct
  source 1..18: mol_type = other DNA
aaatacgaaacattaaag

SEQ ID NO: 66973 - DNA, 18 bp, synthetic construct
  source 1..18: mol_type = other DNA
aaatacgaaacgctttag

SEQ ID NO: 66974 - DNA, 18 bp, synthetic construct
  source 1..18: mol_type = other DNA
aaatacgacacgataaag

SEQ ID NO: 66975 - DNA, 18 bp, synthetic construct
  source 1..18: mol_type = other DNA
aaatacgactcccaaatg

SEQ ID NO: 66976 - DNA, 18 bp, synthetic construct
  source 1..18: mol_type = other DNA
aaatacgactgtcattag

SEQ ID NO: 66977 - DNA, 18 bp, synthetic construct
  source 1..18: mol_type = other DNA
aaatacgatcccagacag

SEQ ID NO: 66978 - DNA, 18 bp, synthetic construct
  source 1..18: mol_type = other DNA
aaatacggtccactataa

SEQ ID NO: 66979 - DNA, 18 bp, synthetic construct
  source 1..18: mol_type = other DNA
aaatacggttcgcttcag

SEQ ID NO: 66980 - DNA, 18 bp, synthetic construct
  source 1..18: mol_type = other DNA
aaatacgtctaacaacag

SEQ ID NO: 66981 - DNA, 18 bp, synthetic construct
  source 1..18: mol_type = other DNA
aaatacgtttaactaatg

SEQ ID NO: 66982 - DNA, 18 bp, synthetic construct
  source 1..18: mol_type = other DNA
aaatactacttattattg

SEQ ID NO: 66983 - DNA, 18 bp, synthetic construct
  source 1..18: mol_type = other DNA
aaatactgttctcaatag

SEQ ID NO: 66984 - DNA, 18 bp, synthetic construct
  source 1..18: mol_type = other DNA
aaatacttctgcctatag

SEQ ID NO: 66985 - DNA, 18 bp, synthetic construct
  source 1..18: mol_type = other DNA
aaatagaatacactattg

SEQ ID NO: 66986 - DNA, 18 bp, synthetic construct
  source 1..18: mol_type = other DNA
aaataggacttgctgtag

SEQ ID NO: 66987 - DNA, 18 bp, synthetic construct
  source 1..18: mol_type = other DNA
aaatagggcactctccag

SEQ ID NO: 66988 - DNA, 18 bp, synthetic construct
  source 1..18: mol_type = other DNA
aaatagtactgtctattg

SEQ ID NO: 66989 - DNA, 18 bp, synthetic construct
  source 1..18: mol_type = other DNA
aaatataactctttttag

SEQ ID NO: 66990 - DNA, 18 bp, synthetic construct
  source 1..18: mol_type = other DNA
aaatatccctcaccatag

SEQ ID NO: 66991 - DNA, 18 bp, synthetic construct
  source 1..18: mol_type = other DNA
aaatatgactacctcagg

SEQ ID NO: 66992 - DNA, 18 bp, synthetic construct
  source 1..18: mol_type = other DNA
aaatatgattcacttaag

SEQ ID NO: 66993 - DNA, 18 bp, synthetic construct
  source 1..18: mol_type = other DNA
aaatatgtctcaccattg

SEQ ID NO: 66994 - DNA, 18 bp, synthetic construct
  source 1..18: mol_type = other DNA
aaatattactctctaaag

SEQ ID NO: 66995 - DNA, 18 bp, synthetic construct
  source 1..18: mol_type = other DNA
aaatattgctcacaatag

SEQ ID NO: 66996 - DNA, 18 bp, synthetic construct
  source 1..18: mol_type = other DNA
aaatcaaactaattaaag

SEQ ID NO: 66997 - DNA, 18 bp, synthetic construct
  source 1..18: mol_type = other DNA
aaatcagactctctaaag

SEQ ID NO: 66998 - DNA, 18 bp, synthetic construct
  source 1..18: mol_type = other DNA
aaatccaattcactttag

SEQ ID NO: 66999 - DNA, 18 bp, synthetic construct
  source 1..18: mol_type = other DNA
aaatccgactctccattg

SEQ ID NO: 67000 - DNA, 18 bp, synthetic construct
  source 1..18: mol_type = other DNA
aaatccgcctcaccaaag

SEQ ID NO: 67001 - DNA, 18 bp, synthetic construct
  source 1..18: mol_type = other DNA
aaatccgtctctctcatg

SEQ ID NO: 67002 - DNA, 18 bp, synthetic construct
  source 1..18: mol_type = other DNA
aaatcctactcatcacag

SEQ ID NO: 67003 - DNA, 18 bp, synthetic construct
  source 1..18: mol_type = other DNA
aaatctgtatcattgtag

SEQ ID NO: 67004 - DNA, 18 bp, synthetic construct
  source 1..18: mol_type = other DNA
aaatgcgaatgtctcttg

SEQ ID NO: 67005 - DNA, 18 bp, synthetic construct
  source 1..18: mol_type = other DNA
aaatgcgtaacattctag

SEQ ID NO: 67006 - DNA, 18 bp, synthetic construct
  source 1..18: mol_type = other DNA
aaattacactaactattg

SEQ ID NO: 67007 - DNA, 18 bp, synthetic construct
  source 1..18: mol_type = other DNA
aaattagtctaactagag

SEQ ID NO: 67008 - DNA, 18 bp, synthetic construct
  source 1..18: mol_type = other DNA
aaattcacctccctatag

SEQ ID NO: 67009 - DNA, 18 bp, synthetic construct
  source 1..18: mol_type = other DNA
aaattcatcttactaaag

SEQ ID NO: 67010 - DNA, 18 bp, synthetic construct
  source 1..18: mol_type = other DNA
aaattccacttgctatag

SEQ ID NO: 67011 - DNA, 18 bp, synthetic construct
  source 1..18: mol_type = other DNA
aaattcgacacactaagg

SEQ ID NO: 67012 - DNA, 18 bp, synthetic construct
  source 1..18: mol_type = other DNA
aaattcgtctcgctacag

SEQ ID NO: 67013 - DNA, 18 bp, synthetic construct
  source 1..18: mol_type = other DNA
aaattcgtcttactatcg

SEQ ID NO: 67014 - DNA, 18 bp, synthetic construct
  source 1..18: mol_type = other DNA
aaattctatactctttag

SEQ ID NO: 67015 - DNA, 18 bp, synthetic construct
  source 1..18: mol_type = other DNA
aaatttaactctctatag

SEQ ID NO: 67016 - DNA, 18 bp, synthetic construct
  source 1..18: mol_type = other DNA
aacaacgtcgcactatag

SEQ ID NO: 67017 - DNA, 18 bp, synthetic construct
  source 1..18: mol_type = other DNA
aacctagactcattatag

SEQ ID NO: 67018 - DNA, 18 bp, synthetic construct
  source 1..18: mol_type = other DNA
aactaaatctcattatag

SEQ ID NO: 67019 - DNA, 18 bp, synthetic construct
  source 1..18: mol_type = other DNA
aactacgaacgtcaacgg

SEQ ID NO: 67020 - DNA, 18 bp, synthetic construct
  source 1..18: mol_type = other DNA
aactacgacacttaaaag

SEQ ID NO: 67021 - DNA, 18 bp, synthetic construct
  source 1..18: mol_type = other DNA
aactacgcatcattatag

SEQ ID NO: 67022 - DNA, 18 bp, synthetic construct
  source 1..18: mol_type = other DNA
aactactatgcactctag

SEQ ID NO: 67023 - DNA, 18 bp, synthetic construct
  source 1..18: mol_type = other DNA
aacttcaactcactcttg

SEQ ID NO: 67024 - DNA, 18 bp, synthetic construct
  source 1..18: mol_type = other DNA
aacttcgaatcaatttag

SEQ ID NO: 67025 - DNA, 18 bp, synthetic construct
  source 1..18: mol_type = other DNA
aagaatgctagattatgg

SEQ ID NO: 67026 - DNA, 18 bp, synthetic construct
  source 1..18: mol_type = other DNA
aagcacgacactttatag

SEQ ID NO: 67027 - DNA, 18 bp, synthetic construct
  source 1..18: mol_type = other DNA
aagcactacactcgaatg

SEQ ID NO: 67028 - DNA, 18 bp, synthetic construct
  source 1..18: mol_type = other DNA
aagtaagtcttactattg

SEQ ID NO: 67029 - DNA, 18 bp, synthetic construct
  source 1..18: mol_type = other DNA
aagtacgacactctatcg

SEQ ID NO: 67030 - DNA, 18 bp, synthetic construct
  source 1..18: mol_type = other DNA
aagtacgactcattgaag

SEQ ID NO: 67031 - DNA, 18 bp, synthetic construct
  source 1..18: mol_type = other DNA
aagtacgagtcaacatag

SEQ ID NO: 67032 - DNA, 18 bp, synthetic construct
  source 1..18: mol_type = other DNA
aagtactactcactttgg

SEQ ID NO: 67033 - DNA, 18 bp, synthetic construct
  source 1..18: mol_type = other DNA
aagttctactctctatag

SEQ ID NO: 67034 - DNA, 18 bp, synthetic construct
  source 1..18: mol_type = other DNA
aataacgattcacaatag

SEQ ID NO: 67035 - DNA, 18 bp, synthetic construct
  source 1..18: mol_type = other DNA
aatagcttctcactatag

SEQ ID NO: 67036 - DNA, 18 bp, synthetic construct
  source 1..18: mol_type = other DNA
aatatcgactcactattg

SEQ ID NO: 67037 - DNA, 18 bp, synthetic construct
  source 1..18: mol_type = other DNA
aatcacgaaccactaaag

SEQ ID NO: 67038 - DNA, 18 bp, synthetic construct
  source 1..18: mol_type = other DNA
aatcacgacttaccatag

SEQ ID NO: 67039 - DNA, 18 bp, synthetic construct
  source 1..18: mol_type = other DNA
aatcatgactcagtgtgg

SEQ ID NO: 67040 - DNA, 18 bp, synthetic construct
  source 1..18: mol_type = other DNA
aatcttgacccgctctag

SEQ ID NO: 67041 - DNA, 18 bp, synthetic construct
  source 1..18: mol_type = other DNA
aatgacaaccaactttag

SEQ ID NO: 67042 - DNA, 18 bp, synthetic construct
  source 1..18: mol_type = other DNA
aatgacgactaactaaag

SEQ ID NO: 67043 - DNA, 18 bp, synthetic construct
  source 1..18: mol_type = other DNA
aatgtcgtctcacatgag

SEQ ID NO: 67044 - DNA, 18 bp, synthetic construct
  source 1..18: mol_type = other DNA
aattaaagaacactttag

SEQ ID NO: 67045 - DNA, 18 bp, synthetic construct
  source 1..18: mol_type = other DNA
aattacaactaacaatag

SEQ ID NO: 67046 - DNA, 18 bp, synthetic construct
  source 1..18: mol_type = other DNA
aattaccactcagtaaag

SEQ ID NO: 67047 - DNA, 18 bp, synthetic construct
  source 1..18: mol_type = other DNA
aattacgacccattaaag

SEQ ID NO: 67048 - DNA, 18 bp, synthetic construct
  source 1..18: mol_type = other DNA
aattacgacgcttcattg

SEQ ID NO: 67049 - DNA, 18 bp, synthetic construct
  source 1..18: mol_type = other DNA
aattacgcctctctaatg

SEQ ID NO: 67050 - DNA, 18 bp, synthetic construct
  source 1..18: mol_type = other DNA
aattacggccctcaaaag

SEQ ID NO: 67051 - DNA, 18 bp, synthetic construct
  source 1..18: mol_type = other DNA
aattacggctcacaattg

SEQ ID NO: 67052 - DNA, 18 bp, synthetic construct
  source 1..18: mol_type = other DNA
aattacggctcctgacag

SEQ ID NO: 67053 - DNA, 18 bp, synthetic construct
  source 1..18: mol_type = other DNA
aattacgtcaaaccttag

SEQ ID NO: 67054 - DNA, 18 bp, synthetic construct
  source 1..18: mol_type = other DNA
aattactcgtgccttaag

SEQ ID NO: 67055 - DNA, 18 bp, synthetic construct
  source 1..18: mol_type = other DNA
aattaggaatcagcatag

SEQ ID NO: 67056 - DNA, 18 bp, synthetic construct
  source 1..18: mol_type = other DNA
aattaggacccatcttag

SEQ ID NO: 67057 - DNA, 18 bp, synthetic construct
  source 1..18: mol_type = other DNA
aattataacttactttag

SEQ ID NO: 67058 - DNA, 18 bp, synthetic construct
  source 1..18: mol_type = other DNA
aattatgacttattatag

SEQ ID NO: 67059 - DNA, 18 bp, synthetic construct
  source 1..18: mol_type = other DNA
aattcagtctcaatatag

SEQ ID NO: 67060 - DNA, 18 bp, synthetic construct
  source 1..18: mol_type = other DNA
aattgggacttccttttg

SEQ ID NO: 67061 - DNA, 18 bp, synthetic construct
  source 1..18: mol_type = other DNA
aatttccaaactccatag

SEQ ID NO: 67062 - DNA, 18 bp, synthetic construct
  source 1..18: mol_type = other DNA
aatttcgacacaccattg

SEQ ID NO: 67063 - DNA, 18 bp, synthetic construct
  source 1..18: mol_type = other DNA
aatttctactccctatag

SEQ ID NO: 67064 - DNA, 18 bp, synthetic construct
  source 1..18: mol_type = other DNA
aatttctcttcaataaag

SEQ ID NO: 67065 - DNA, 18 bp, synthetic construct
  source 1..18: mol_type = other DNA
acaaaccactcactacag

SEQ ID NO: 67066 - DNA, 18 bp, synthetic construct
  source 1..18: mol_type = other DNA
acactccactctctgtag

SEQ ID NO: 67067 - DNA, 18 bp, synthetic construct
  source 1..18: mol_type = other DNA
acataagcctccctctag

SEQ ID NO: 67068 - DNA, 18 bp, synthetic construct
  source 1..18: mol_type = other DNA
acatacgactcatttgag

SEQ ID NO: 67069 - DNA, 18 bp, synthetic construct
  source 1..18: mol_type = other DNA
acatacgtgacactattg

SEQ ID NO: 67070 - DNA, 18 bp, synthetic construct
  source 1..18: mol_type = other DNA
acatatcaaccgctttag

SEQ ID NO: 67071 - DNA, 18 bp, synthetic construct
  source 1..18: mol_type = other DNA
acatatgacacacaatag

SEQ ID NO: 67072 - DNA, 18 bp, synthetic construct
  source 1..18: mol_type = other DNA
acatatgactcacttaag

SEQ ID NO: 67073 - DNA, 18 bp, synthetic construct
  source 1..18: mol_type = other DNA
acatgggtatcactattg

SEQ ID NO: 67074 - DNA, 18 bp, synthetic construct
  source 1..18: mol_type = other DNA
acatgtgactctctatcg

SEQ ID NO: 67075 - DNA, 18 bp, synthetic construct
  source 1..18: mol_type = other DNA
acattccactccctatag

SEQ ID NO: 67076 - DNA, 18 bp, synthetic construct
  source 1..18: mol_type = other DNA
acgcgcgactcgctaatg

SEQ ID NO: 67077 - DNA, 18 bp, synthetic construct
  source 1..18: mol_type = other DNA
acgttcaactcactatag

SEQ ID NO: 67078 - DNA, 18 bp, synthetic construct
  source 1..18: mol_type = other DNA
actcacgatccactattg

SEQ ID NO: 67079 - DNA, 18 bp, synthetic construct
  source 1..18: mol_type = other DNA
acttacgaatctctattg

SEQ ID NO: 67080 - DNA, 18 bp, synthetic construct
  source 1..18: mol_type = other DNA
acttatgtctcaaatttg

SEQ ID NO: 67081 - DNA, 18 bp, synthetic construct
  source 1..18: mol_type = other DNA
agaaacgaccatttacgg

SEQ ID NO: 67082 - DNA, 18 bp, synthetic construct
  source 1..18: mol_type = other DNA
agacatgactcccaatag

SEQ ID NO: 67083 - DNA, 18 bp, synthetic construct
  source 1..18: mol_type = other DNA
agacatgagtcactctag

SEQ ID NO: 67084 - DNA, 18 bp, synthetic construct
  source 1..18: mol_type = other DNA
agacccgacacactacag

SEQ ID NO: 67085 - DNA, 18 bp, synthetic construct
  source 1..18: mol_type = other DNA
agagaagactcacaatag

SEQ ID NO: 67086 - DNA, 18 bp, synthetic construct
  source 1..18: mol_type = other DNA
agataagtctcactttag

SEQ ID NO: 67087 - DNA, 18 bp, synthetic construct
  source 1..18: mol_type = other DNA
agatacaactcatcatag

SEQ ID NO: 67088 - DNA, 18 bp, synthetic construct
  source 1..18: mol_type = other DNA
agatacggctcacttaag

SEQ ID NO: 67089 - DNA, 18 bp, synthetic construct
  source 1..18: mol_type = other DNA
agatacgtcttactattg

SEQ ID NO: 67090 - DNA, 18 bp, synthetic construct
  source 1..18: mol_type = other DNA
agatcagccactgtattg

SEQ ID NO: 67091 - DNA, 18 bp, synthetic construct
  source 1..18: mol_type = other DNA
agatccacgtccctttag

SEQ ID NO: 67092 - DNA, 18 bp, synthetic construct
  source 1..18: mol_type = other DNA
agatttgactcattgtcg

SEQ ID NO: 67093 - DNA, 18 bp, synthetic construct
  source 1..18: mol_type = other DNA
agcaacatctcacaatag

SEQ ID NO: 67094 - DNA, 18 bp, synthetic construct
  source 1..18: mol_type = other DNA
aggttagactcatcaaag

SEQ ID NO: 67095 - DNA, 18 bp, synthetic construct
  source 1..18: mol_type = other DNA
aggttcgactctctatag

SEQ ID NO: 67096 - DNA, 18 bp, synthetic construct
  source 1..18: mol_type = other DNA
agtaacgactcactttag

SEQ ID NO: 67097 - DNA, 18 bp, synthetic construct
  source 1..18: mol_type = other DNA
agttacaactcagtttag

SEQ ID NO: 67098 - DNA, 18 bp, synthetic construct
  source 1..18: mol_type = other DNA
agttacgactcacttaag

SEQ ID NO: 67099 - DNA, 18 bp, synthetic construct
  source 1..18: mol_type = other DNA
agttacgattcactaaag

SEQ ID NO: 67100 - DNA, 18 bp, synthetic construct
  source 1..18: mol_type = other DNA
agttacgcaaaatgagag

SEQ ID NO: 67101 - DNA, 18 bp, synthetic construct
  source 1..18: mol_type = other DNA
ataaacgacacactaaag

SEQ ID NO: 67102 - DNA, 18 bp, synthetic construct
  source 1..18: mol_type = other DNA
ataaactgcccactatag

SEQ ID NO: 67103 - DNA, 18 bp, synthetic construct
  source 1..18: mol_type = other DNA
ataaatgccttggctcag

SEQ ID NO: 67104 - DNA, 18 bp, synthetic construct
  source 1..18: mol_type = other DNA
ataatcgactcactaatg

SEQ ID NO: 67105 - DNA, 18 bp, synthetic construct
  source 1..18: mol_type = other DNA
ataatcgtctcactttag

SEQ ID NO: 67106 - DNA, 18 bp, synthetic construct
  source 1..18: mol_type = other DNA
ataatttacgtagtaaag

SEQ ID NO: 67107 - DNA, 18 bp, synthetic construct
  source 1..18: mol_type = other DNA
atacaccataccctatgg

SEQ ID NO: 67108 - DNA, 18 bp, synthetic construct
  source 1..18: mol_type = other DNA
atacacgaattagtatag

SEQ ID NO: 67109 - DNA, 18 bp, synthetic construct
  source 1..18: mol_type = other DNA
atacacgtccccctttag

SEQ ID NO: 67110 - DNA, 18 bp, synthetic construct
  source 1..18: mol_type = other DNA
atacattacacactcgtg

SEQ ID NO: 67111 - DNA, 18 bp, synthetic construct
  source 1..18: mol_type = other DNA
atacattactcacaatag

SEQ ID NO: 67112 - DNA, 18 bp, synthetic construct
  source 1..18: mol_type = other DNA
atataatattgtctatag

SEQ ID NO: 67113 - DNA, 18 bp, synthetic construct
  source 1..18: mol_type = other DNA
atatacaactcattattg

SEQ ID NO: 67114 - DNA, 18 bp, synthetic construct
  source 1..18: mol_type = other DNA
atataccacagtctatcg

SEQ ID NO: 67115 - DNA, 18 bp, synthetic construct
  source 1..18: mol_type = other DNA
atatacgaatcagaaagg

SEQ ID NO: 67116 - DNA, 18 bp, synthetic construct
  source 1..18: mol_type = other DNA
atatacgaattaccatag

SEQ ID NO: 67117 - DNA, 18 bp, synthetic construct
  source 1..18: mol_type = other DNA
atatacgactaactgttg

SEQ ID NO: 67118 - DNA, 18 bp, synthetic construct
  source 1..18: mol_type = other DNA
atatacgactctactctg

SEQ ID NO: 67119 - DNA, 18 bp, synthetic construct
  source 1..18: mol_type = other DNA
atatacgactcttaatcg

SEQ ID NO: 67120 - DNA, 18 bp, synthetic construct
  source 1..18: mol_type = other DNA
atatacgacttaatttag

SEQ ID NO: 67121 - DNA, 18 bp, synthetic construct
  source 1..18: mol_type = other DNA
atatacgacttactaatg

SEQ ID NO: 67122 - DNA, 18 bp, synthetic construct
  source 1..18: mol_type = other DNA
atatacgatacacattag

SEQ ID NO: 67123 - DNA, 18 bp, synthetic construct
  source 1..18: mol_type = other DNA
atatacgattcataatag

SEQ ID NO: 67124 - DNA, 18 bp, synthetic construct
  source 1..18: mol_type = other DNA
atatacggaagactattg

SEQ ID NO: 67125 - DNA, 18 bp, synthetic construct
  source 1..18: mol_type = other DNA
atatacgtatgactatag

SEQ ID NO: 67126 - DNA, 18 bp, synthetic construct
  source 1..18: mol_type = other DNA
atatacgtctatctattg

SEQ ID NO: 67127 - DNA, 18 bp, synthetic construct
  source 1..18: mol_type = other DNA
atatactacacaccttgg

SEQ ID NO: 67128 - DNA, 18 bp, synthetic construct
  source 1..18: mol_type = other DNA
atatactacccactatgg

SEQ ID NO: 67129 - DNA, 18 bp, synthetic construct
  source 1..18: mol_type = other DNA
atatactactgactaaag

SEQ ID NO: 67130 - DNA, 18 bp, synthetic construct
  source 1..18: mol_type = other DNA
atatataactctctatag

SEQ ID NO: 67131 - DNA, 18 bp, synthetic construct
  source 1..18: mol_type = other DNA
atatatgacgcattaatg

SEQ ID NO: 67132 - DNA, 18 bp, synthetic construct
  source 1..18: mol_type = other DNA
atatccgaatttcaatag

SEQ ID NO: 67133 - DNA, 18 bp, synthetic construct
  source 1..18: mol_type = other DNA
atatccgactcattatgg

SEQ ID NO: 67134 - DNA, 18 bp, synthetic construct
  source 1..18: mol_type = other DNA
atatccgactccctaatg

SEQ ID NO: 67135 - DNA, 18 bp, synthetic construct
  source 1..18: mol_type = other DNA
atatcggtctcactttgg

SEQ ID NO: 67136 - DNA, 18 bp, synthetic construct
  source 1..18: mol_type = other DNA
atattcgactccgtagag

SEQ ID NO: 67137 - DNA, 18 bp, synthetic construct
  source 1..18: mol_type = other DNA
atattcggctcactttag

SEQ ID NO: 67138 - DNA, 18 bp, synthetic construct
  source 1..18: mol_type = other DNA
atattctactcaccctag

SEQ ID NO: 67139 - DNA, 18 bp, synthetic construct
  source 1..18: mol_type = other DNA
atattggattcactatag

SEQ ID NO: 67140 - DNA, 18 bp, synthetic construct
  source 1..18: mol_type = other DNA
atatttgtctcactatag

SEQ ID NO: 67141 - DNA, 18 bp, synthetic construct
  source 1..18: mol_type = other DNA
atcaaccactcgctaccg

SEQ ID NO: 67142 - DNA, 18 bp, synthetic construct
  source 1..18: mol_type = other DNA
atctaagactcgcattag

SEQ ID NO: 67143 - DNA, 18 bp, synthetic construct
  source 1..18: mol_type = other DNA
atctacttctcaatatag

SEQ ID NO: 67144 - DNA, 18 bp, synthetic construct
  source 1..18: mol_type = other DNA
atctccgactctcacttg

SEQ ID NO: 67145 - DNA, 18 bp, synthetic construct
  source 1..18: mol_type = other DNA
attaatttttgattatag

SEQ ID NO: 67146 - DNA, 18 bp, synthetic construct
  source 1..18: mol_type = other DNA
atttacatctccatatag

SEQ ID NO: 67147 - DNA, 18 bp, synthetic construct
  source 1..18: mol_type = other DNA
atttacgacaccctatag

SEQ ID NO: 67148 - DNA, 18 bp, synthetic construct
  source 1..18: mol_type = other DNA
atttacgactctctcaag

SEQ ID NO: 67149 - DNA, 18 bp, synthetic construct
  source 1..18: mol_type = other DNA
atttacgactgaacacag

SEQ ID NO: 67150 - DNA, 18 bp, synthetic construct
  source 1..18: mol_type = other DNA
atttacgtctcgctatgg

SEQ ID NO: 67151 - DNA, 18 bp, synthetic construct
  source 1..18: mol_type = other DNA
atttacgtttcaaaagag

SEQ ID NO: 67152 - DNA, 18 bp, synthetic construct
  source 1..18: mol_type = other DNA
attttcgactcacaatag

SEQ ID NO: 67153 - DNA, 18 bp, synthetic construct
  source 1..18: mol_type = other DNA
atttttaaatacgaattg

SEQ ID NO: 67154 - DNA, 18 bp, synthetic construct
  source 1..18: mol_type = other DNA
caaaaaccctctctatcg

SEQ ID NO: 67155 - DNA, 18 bp, synthetic construct
  source 1..18: mol_type = other DNA
caaaaagtcacattatag

SEQ ID NO: 67156 - DNA, 18 bp, synthetic construct
  source 1..18: mol_type = other DNA
caaaacgactcccattag

SEQ ID NO: 67157 - DNA, 18 bp, synthetic construct
  source 1..18: mol_type = other DNA
caaaacgactctctaatg

SEQ ID NO: 67158 - DNA, 18 bp, synthetic construct
  source 1..18: mol_type = other DNA
caaaacgcctcactgtcg

SEQ ID NO: 67159 - DNA, 18 bp, synthetic construct
  source 1..18: mol_type = other DNA
caaaacggctgtcaaaag

SEQ ID NO: 67160 - DNA, 18 bp, synthetic construct
  source 1..18: mol_type = other DNA
caaaccgtctttctatag

SEQ ID NO: 67161 - DNA, 18 bp, synthetic construct
  source 1..18: mol_type = other DNA
caacaaaactccctatgg

SEQ ID NO: 67162 - DNA, 18 bp, synthetic construct
  source 1..18: mol_type = other DNA
caacgctccttataattg

SEQ ID NO: 67163 - DNA, 18 bp, synthetic construct
  source 1..18: mol_type = other DNA
caataaaacttagagaag

SEQ ID NO: 67164 - DNA, 18 bp, synthetic construct
  source 1..18: mol_type = other DNA
caatacacctctgcacag

SEQ ID NO: 67165 - DNA, 18 bp, synthetic construct
  source 1..18: mol_type = other DNA
caataccattcacaatgg

SEQ ID NO: 67166 - DNA, 18 bp, synthetic construct
  source 1..18: mol_type = other DNA
caatacctcacactttag

SEQ ID NO: 67167 - DNA, 18 bp, synthetic construct
  source 1..18: mol_type = other DNA
caatacgagtaacttatg

SEQ ID NO: 67168 - DNA, 18 bp, synthetic construct
  source 1..18: mol_type = other DNA
caatacgattctcttatg

SEQ ID NO: 67169 - DNA, 18 bp, synthetic construct
  source 1..18: mol_type = other DNA
caatacgatttactaccg

SEQ ID NO: 67170 - DNA, 18 bp, synthetic construct
  source 1..18: mol_type = other DNA
caatacgtctcacattcg

SEQ ID NO: 67171 - DNA, 18 bp, synthetic construct
  source 1..18: mol_type = other DNA
caatacgtctcgctactg

SEQ ID NO: 67172 - DNA, 18 bp, synthetic construct
  source 1..18: mol_type = other DNA
caatacgtcttaatattg

SEQ ID NO: 67173 - DNA, 18 bp, synthetic construct
  source 1..18: mol_type = other DNA
caatactaatctcgatag

SEQ ID NO: 67174 - DNA, 18 bp, synthetic construct
  source 1..18: mol_type = other DNA
caatactactaaccaaag

SEQ ID NO: 67175 - DNA, 18 bp, synthetic construct
  source 1..18: mol_type = other DNA
caatactattaactacag

SEQ ID NO: 67176 - DNA, 18 bp, synthetic construct
  source 1..18: mol_type = other DNA
caatacttcacacgatag

SEQ ID NO: 67177 - DNA, 18 bp, synthetic construct
  source 1..18: mol_type = other DNA
caatctcactcattatgg

SEQ ID NO: 67178 - DNA, 18 bp, synthetic construct
  source 1..18: mol_type = other DNA
caatgaaacacactaaag

SEQ ID NO: 67179 - DNA, 18 bp, synthetic construct
  source 1..18: mol_type = other DNA
caatgcgacactctacag

SEQ ID NO: 67180 - DNA, 18 bp, synthetic construct
  source 1..18: mol_type = other DNA
caattagactctttatcg

SEQ ID NO: 67181 - DNA, 18 bp, synthetic construct
  source 1..18: mol_type = other DNA
caattcatctcactattg

SEQ ID NO: 67182 - DNA, 18 bp, synthetic construct
  source 1..18: mol_type = other DNA
caattcatttctttaaag

SEQ ID NO: 67183 - DNA, 18 bp, synthetic construct
  source 1..18: mol_type = other DNA
caattcgaattactttag

SEQ ID NO: 67184 - DNA, 18 bp, synthetic construct
  source 1..18: mol_type = other DNA
caattcgagttgctacag

SEQ ID NO: 67185 - DNA, 18 bp, synthetic construct
  source 1..18: mol_type = other DNA
caattcgattcaagatag

SEQ ID NO: 67186 - DNA, 18 bp, synthetic construct
  source 1..18: mol_type = other DNA
caattcggcccactattg

SEQ ID NO: 67187 - DNA, 18 bp, synthetic construct
  source 1..18: mol_type = other DNA
caattggattcactatgg

SEQ ID NO: 67188 - DNA, 18 bp, synthetic construct
  source 1..18: mol_type = other DNA
caccccgaatctgtatag

SEQ ID NO: 67189 - DNA, 18 bp, synthetic construct
  source 1..18: mol_type = other DNA
cactacaacttagtatag

SEQ ID NO: 67190 - DNA, 18 bp, synthetic construct
  source 1..18: mol_type = other DNA
cactacagttcattatgg

SEQ ID NO: 67191 - DNA, 18 bp, synthetic construct
  source 1..18: mol_type = other DNA
cactacgactatatatag

SEQ ID NO: 67192 - DNA, 18 bp, synthetic construct
  source 1..18: mol_type = other DNA
cactcagactcacttaag

SEQ ID NO: 67193 - DNA, 18 bp, synthetic construct
  source 1..18: mol_type = other DNA
cagaaaatctcacaatag

SEQ ID NO: 67194 - DNA, 18 bp, synthetic construct
  source 1..18: mol_type = other DNA
cagtacaacttattatag

SEQ ID NO: 67195 - DNA, 18 bp, synthetic construct
  source 1..18: mol_type = other DNA
cagtaggtatcacagcag

SEQ ID NO: 67196 - DNA, 18 bp, synthetic construct
  source 1..18: mol_type = other DNA
catagcgacttacaatcg

SEQ ID NO: 67197 - DNA, 18 bp, synthetic construct
  source 1..18: mol_type = other DNA
cattaagactcaaaatag

SEQ ID NO: 67198 - DNA, 18 bp, synthetic construct
  source 1..18: mol_type = other DNA
cattaccacaaccaattg

SEQ ID NO: 67199 - DNA, 18 bp, synthetic construct
  source 1..18: mol_type = other DNA
cattacgacacacttaag

SEQ ID NO: 67200 - DNA, 18 bp, synthetic construct
  source 1..18: mol_type = other DNA
cattacgactctcattag

SEQ ID NO: 67201 - DNA, 18 bp, synthetic construct
  source 1..18: mol_type = other DNA
cattactactaaatacag

SEQ ID NO: 67202 - DNA, 18 bp, synthetic construct
  source 1..18: mol_type = other DNA
cattacttctctctaaag

SEQ ID NO: 67203 - DNA, 18 bp, synthetic construct
  source 1..18: mol_type = other DNA
cattccgtcttacaatag

SEQ ID NO: 67204 - DNA, 18 bp, synthetic construct
  source 1..18: mol_type = other DNA
catttcgaatcaccatag

SEQ ID NO: 67205 - DNA, 18 bp, synthetic construct
  source 1..18: mol_type = other DNA
catttcgactcgttatag

SEQ ID NO: 67206 - DNA, 18 bp, synthetic construct
  source 1..18: mol_type = other DNA
catttcgtcacactaccg

SEQ ID NO: 67207 - DNA, 18 bp, synthetic construct
  source 1..18: mol_type = other DNA
catttcgtgtcattaatg

SEQ ID NO: 67208 - DNA, 18 bp, synthetic construct
  source 1..18: mol_type = other DNA
ccacaccactcaatattg

SEQ ID NO: 67209 - DNA, 18 bp, synthetic construct
  source 1..18: mol_type = other DNA
ccataattctcacaatag

SEQ ID NO: 67210 - DNA, 18 bp, synthetic construct
  source 1..18: mol_type = other DNA
ccatacgactctttaaag

SEQ ID NO: 67211 - DNA, 18 bp, synthetic construct
  source 1..18: mol_type = other DNA
ccatacgcatgactacag

SEQ ID NO: 67212 - DNA, 18 bp, synthetic construct
  source 1..18: mol_type = other DNA
ccatatcactcactattg

SEQ ID NO: 67213 - DNA, 18 bp, synthetic construct
  source 1..18: mol_type = other DNA
ccatccgtctcatttttg

SEQ ID NO: 67214 - DNA, 18 bp, synthetic construct
  source 1..18: mol_type = other DNA
cgagatgtttcattttag

SEQ ID NO: 67215 - DNA, 18 bp, synthetic construct
  source 1..18: mol_type = other DNA
cgatacgtctctcttatg

SEQ ID NO: 67216 - DNA, 18 bp, synthetic construct
  source 1..18: mol_type = other DNA
ctaaacgactcacttttg

SEQ ID NO: 67217 - DNA, 18 bp, synthetic construct
  source 1..18: mol_type = other DNA
ctaaacgtatccctaatg

SEQ ID NO: 67218 - DNA, 18 bp, synthetic construct
  source 1..18: mol_type = other DNA
ctaagcgactcactatcg

SEQ ID NO: 67219 - DNA, 18 bp, synthetic construct
  source 1..18: mol_type = other DNA
ctagacaacattccatag

SEQ ID NO: 67220 - DNA, 18 bp, synthetic construct
  source 1..18: mol_type = other DNA
ctatacgacaatctatag

SEQ ID NO: 67221 - DNA, 18 bp, synthetic construct
  source 1..18: mol_type = other DNA
ctatacgacaccatatgg

SEQ ID NO: 67222 - DNA, 18 bp, synthetic construct
  source 1..18: mol_type = other DNA
ctatacgattccctctag

SEQ ID NO: 67223 - DNA, 18 bp, synthetic construct
  source 1..18: mol_type = other DNA
ctatacgattctcaatag

SEQ ID NO: 67224 - DNA, 18 bp, synthetic construct
  source 1..18: mol_type = other DNA
ctatcctactcataacag

SEQ ID NO: 67225 - DNA, 18 bp, synthetic construct
  source 1..18: mol_type = other DNA
ctattcgacttactaaag

SEQ ID NO: 67226 - DNA, 18 bp, synthetic construct
  source 1..18: mol_type = other DNA
ctattcgattctctattg

SEQ ID NO: 67227 - DNA, 18 bp, synthetic construct
  source 1..18: mol_type = other DNA
ctgtacaacacactatag

SEQ ID NO: 67228 - DNA, 18 bp, synthetic construct
  source 1..18: mol_type = other DNA
cttatcgactttcaaagg

SEQ ID NO: 67229 - DNA, 18 bp, synthetic construct
  source 1..18: mol_type = other DNA
ctttacgactcgcaatag

SEQ ID NO: 67230 - DNA, 18 bp, synthetic construct
  source 1..18: mol_type = other DNA
ctttacgactgactaaag

SEQ ID NO: 67231 - DNA, 18 bp, synthetic construct
  source 1..18: mol_type = other DNA
ctttacgtctaactatag

SEQ ID NO: 67232 - DNA, 18 bp, synthetic construct
  source 1..18: mol_type = other DNA
gaacacgtctcattaatg

SEQ ID NO: 67233 - DNA, 18 bp, synthetic construct
  source 1..18: mol_type = other DNA
gaataaacttcagtttag

SEQ ID NO: 67234 - DNA, 18 bp, synthetic construct
  source 1..18: mol_type = other DNA
gaatacgaaagactattg

SEQ ID NO: 67235 - DNA, 18 bp, synthetic construct
  source 1..18: mol_type = other DNA
gaatacgagacactaatg

SEQ ID NO: 67236 - DNA, 18 bp, synthetic construct
  source 1..18: mol_type = other DNA
gaatatatctctctatag

SEQ ID NO: 67237 - DNA, 18 bp, synthetic construct
  source 1..18: mol_type = other DNA
gaatattgcgcactattg

SEQ ID NO: 67238 - DNA, 18 bp, synthetic construct
  source 1..18: mol_type = other DNA
gaatcagtccaactaaag

SEQ ID NO: 67239 - DNA, 18 bp, synthetic construct
  source 1..18: mol_type = other DNA
gaattcaactgtctagag

SEQ ID NO: 67240 - DNA, 18 bp, synthetic construct
  source 1..18: mol_type = other DNA
gacgacggctgactaaag

SEQ ID NO: 67241 - DNA, 18 bp, synthetic construct
  source 1..18: mol_type = other DNA
gataacatctaattaaag

SEQ ID NO: 67242 - DNA, 18 bp, synthetic construct
  source 1..18: mol_type = other DNA
gataacgactaactaaag

SEQ ID NO: 67243 - DNA, 18 bp, synthetic construct
  source 1..18: mol_type = other DNA
gatggccactcgatatag

SEQ ID NO: 67244 - DNA, 18 bp, synthetic construct
  source 1..18: mol_type = other DNA
gattaggactcacaattg

SEQ ID NO: 67245 - DNA, 18 bp, synthetic construct
  source 1..18: mol_type = other DNA
gattcgacctccctatcg

SEQ ID NO: 67246 - DNA, 18 bp, synthetic construct
  source 1..18: mol_type = other DNA
gcaatagcctcactatag

SEQ ID NO: 67247 - DNA, 18 bp, synthetic construct
  source 1..18: mol_type = other DNA
gcacaagacttactatag

SEQ ID NO: 67248 - DNA, 18 bp, synthetic construct
  source 1..18: mol_type = other DNA
gcatacgatagactaacg

SEQ ID NO: 67249 - DNA, 18 bp, synthetic construct
  source 1..18: mol_type = other DNA
gcctacgacataccatag

SEQ ID NO: 67250 - DNA, 18 bp, synthetic construct
  source 1..18: mol_type = other DNA
ggatatgactcactgttg

SEQ ID NO: 67251 - DNA, 18 bp, synthetic construct
  source 1..18: mol_type = other DNA
gtatacgtcccacttcag

SEQ ID NO: 67252 - DNA, 18 bp, synthetic construct
  source 1..18: mol_type = other DNA
gtatacgtctcagtaaag

SEQ ID NO: 67253 - DNA, 18 bp, synthetic construct
  source 1..18: mol_type = other DNA
gtattcgactcaatttag

SEQ ID NO: 67254 - DNA, 18 bp, synthetic construct
  source 1..18: mol_type = other DNA
gtgtccgactcactatcg

SEQ ID NO: 67255 - DNA, 18 bp, synthetic construct
  source 1..18: mol_type = other DNA
gtttaagtttaacattag

SEQ ID NO: 67256 - DNA, 18 bp, synthetic construct
  source 1..18: mol_type = other DNA
taaaaagacacactgcag

SEQ ID NO: 67257 - DNA, 18 bp, synthetic construct
  source 1..18: mol_type = other DNA
taaaaagagtcgctacag

SEQ ID NO: 67258 - DNA, 18 bp, synthetic construct
  source 1..18: mol_type = other DNA
taaaacaacacacctttg

SEQ ID NO: 67259 - DNA, 18 bp, synthetic construct
  source 1..18: mol_type = other DNA
taaaacaacatactattg

SEQ ID NO: 67260 - DNA, 18 bp, synthetic construct
  source 1..18: mol_type = other DNA
taaaacaaccaaatattg

SEQ ID NO: 67261 - DNA, 18 bp, synthetic construct
  source 1..18: mol_type = other DNA
taaaacaatacactaatg

SEQ ID NO: 67262 - DNA, 18 bp, synthetic construct
  source 1..18: mol_type = other DNA
taaaacaattaactattg

SEQ ID NO: 67263 - DNA, 18 bp, synthetic construct
  source 1..18: mol_type = other DNA
taaaacaattgcctgttg

SEQ ID NO: 67264 - DNA, 18 bp, synthetic construct
  source 1..18: mol_type = other DNA
taaaacagctcacaattg

SEQ ID NO: 67265 - DNA, 18 bp, synthetic construct
  source 1..18: mol_type = other DNA
taaaacatcccacttctg

SEQ ID NO: 67266 - DNA, 18 bp, synthetic construct
  source 1..18: mol_type = other DNA
taaaacatctccttgtcg

SEQ ID NO: 67267 - DNA, 18 bp, synthetic construct
  source 1..18: mol_type = other DNA
taaaaccactcacttacg

SEQ ID NO: 67268 - DNA, 18 bp, synthetic construct
  source 1..18: mol_type = other DNA
taaaaccattaactcttg

SEQ ID NO: 67269 - DNA, 18 bp, synthetic construct
  source 1..18: mol_type = other DNA
taaaacgaattgctttag

SEQ ID NO: 67270 - DNA, 18 bp, synthetic construct
  source 1..18: mol_type = other DNA
taaaacgacactcatttg

SEQ ID NO: 67271 - DNA, 18 bp, synthetic construct
  source 1..18: mol_type = other DNA
taaaacgactatcttaag

SEQ ID NO: 67272 - DNA, 18 bp, synthetic construct
  source 1..18: mol_type = other DNA
taaaacgactctcaagcg

SEQ ID NO: 67273 - DNA, 18 bp, synthetic construct
  source 1..18: mol_type = other DNA
taaaacgactctctacga

SEQ ID NO: 67274 - DNA, 18 bp, synthetic construct
  source 1..18: mol_type = other DNA
taaaacgagttacttttg

SEQ ID NO: 67275 - DNA, 18 bp, synthetic construct
  source 1..18: mol_type = other DNA
taaaacgatccaatggag

SEQ ID NO: 67276 - DNA, 18 bp, synthetic construct
  source 1..18: mol_type = other DNA
taaaacgattcacatttg

SEQ ID NO: 67277 - DNA, 18 bp, synthetic construct
  source 1..18: mol_type = other DNA
taaaacgattcatcacgg

SEQ ID NO: 67278 - DNA, 18 bp, synthetic construct
  source 1..18: mol_type = other DNA
taaaacgcgtaactttag

SEQ ID NO: 67279 - DNA, 18 bp, synthetic construct
  source 1..18: mol_type = other DNA
taaaacgtcaaactattg

SEQ ID NO: 67280 - DNA, 18 bp, synthetic construct
  source 1..18: mol_type = other DNA
taaaacgtcacactccag

SEQ ID NO: 67281 - DNA, 18 bp, synthetic construct
  source 1..18: mol_type = other DNA
taaaacgtcttacaaaag

SEQ ID NO: 67282 - DNA, 18 bp, synthetic construct
  source 1..18: mol_type = other DNA
taaaactaactattatag

SEQ ID NO: 67283 - DNA, 18 bp, synthetic construct
  source 1..18: mol_type = other DNA
taaaactaatcaatacag

SEQ ID NO: 67284 - DNA, 18 bp, synthetic construct
  source 1..18: mol_type = other DNA
taaaactactaacactag

SEQ ID NO: 67285 - DNA, 18 bp, synthetic construct
  source 1..18: mol_type = other DNA
taaaactactcatcctag

SEQ ID NO: 67286 - DNA, 18 bp, synthetic construct
  source 1..18: mol_type = other DNA
taaaactatacaatttag

SEQ ID NO: 67287 - DNA, 18 bp, synthetic construct
  source 1..18: mol_type = other DNA
taaaacttcaaactatag

SEQ ID NO: 67288 - DNA, 18 bp, synthetic construct
  source 1..18: mol_type = other DNA
taaaacttcacactaaag

SEQ ID NO: 67289 - DNA, 18 bp, synthetic construct
  source 1..18: mol_type = other DNA
taaaacttctctacatag

SEQ ID NO: 67290 - DNA, 18 bp, synthetic construct
  source 1..18: mol_type = other DNA
taaaagaaaacataaaag

SEQ ID NO: 67291 - DNA, 18 bp, synthetic construct
  source 1..18: mol_type = other DNA
taaaagaactccccatag

SEQ ID NO: 67292 - DNA, 18 bp, synthetic construct
  source 1..18: mol_type = other DNA
taaaagatcccactttag

SEQ ID NO: 67293 - DNA, 18 bp, synthetic construct
  source 1..18: mol_type = other DNA
taaaaggacactcaaaag

SEQ ID NO: 67294 - DNA, 18 bp, synthetic construct
  source 1..18: mol_type = other DNA
taaaaggactatttatag

SEQ ID NO: 67295 - DNA, 18 bp, synthetic construct
  source 1..18: mol_type = other DNA
taaaaggactcaattatg

SEQ ID NO: 67296 - DNA, 18 bp, synthetic construct
  source 1..18: mol_type = other DNA
taaaataactcagtgatg

SEQ ID NO: 67297 - DNA, 18 bp, synthetic construct
  source 1..18: mol_type = other DNA
taaaatcattcactctag

SEQ ID NO: 67298 - DNA, 18 bp, synthetic construct
  source 1..18: mol_type = other DNA
taaaatgaaacattacag

SEQ ID NO: 67299 - DNA, 18 bp, synthetic construct
  source 1..18: mol_type = other DNA
taaaatgactaacgacag

SEQ ID NO: 67300 - DNA, 18 bp, synthetic construct
  source 1..18: mol_type = other DNA
taaaatgactctcaaaag

SEQ ID NO: 67301 - DNA, 18 bp, synthetic construct
  source 1..18: mol_type = other DNA
taaaatgacttacttgag

SEQ ID NO: 67302 - DNA, 18 bp, synthetic construct
  source 1..18: mol_type = other DNA
taaacagactcaatgcag

SEQ ID NO: 67303 - DNA, 18 bp, synthetic construct
  source 1..18: mol_type = other DNA
taaacagatttactttag

SEQ ID NO: 67304 - DNA, 18 bp, synthetic construct
  source 1..18: mol_type = other DNA
taaaccgtcacgcaaaag

SEQ ID NO: 67305 - DNA, 18 bp, synthetic construct
  source 1..18: mol_type = other DNA
taaagcgactagctttag

SEQ ID NO: 67306 - DNA, 18 bp, synthetic construct
  source 1..18: mol_type = other DNA
taaagcggatgactatag

SEQ ID NO: 67307 - DNA, 18 bp, synthetic construct
  source 1..18: mol_type = other DNA
taaagctacacaatatag

SEQ ID NO: 67308 - DNA, 18 bp, synthetic construct
  source 1..18: mol_type = other DNA
taaaggcacttactatag

SEQ ID NO: 67309 - DNA, 18 bp, synthetic construct
  source 1..18: mol_type = other DNA
taaatagactatctatag

SEQ ID NO: 67310 - DNA, 18 bp, synthetic construct
  source 1..18: mol_type = other DNA
taaatcgaaccacttcag

SEQ ID NO: 67311 - DNA, 18 bp, synthetic construct
  source 1..18: mol_type = other DNA
taaatcgactcacacttg

SEQ ID NO: 67312 - DNA, 18 bp, synthetic construct
  source 1..18: mol_type = other DNA
taaatcgagtttcctttg

SEQ ID NO: 67313 - DNA, 18 bp, synthetic construct
  source 1..18: mol_type = other DNA
taaatcgtcccacttgtg

SEQ ID NO: 67314 - DNA, 18 bp, synthetic construct
  source 1..18: mol_type = other DNA
taaatctactcactgtcg

SEQ ID NO: 67315 - DNA, 18 bp, synthetic construct
  source 1..18: mol_type = other DNA
taaattgactctccatag

SEQ ID NO: 67316 - DNA, 18 bp, synthetic construct
  source 1..18: mol_type = other DNA
taaattgacttaccatag

SEQ ID NO: 67317 - DNA, 18 bp, synthetic construct
  source 1..18: mol_type = other DNA
taacaagacaaaccatag

SEQ ID NO: 67318 - DNA, 18 bp, synthetic construct
  source 1..18: mol_type = other DNA
taacaagactagatttag

SEQ ID NO: 67319 - DNA, 18 bp, synthetic construct
  source 1..18: mol_type = other DNA
taacacaaatctcgatag

SEQ ID NO: 67320 - DNA, 18 bp, synthetic construct
  source 1..18: mol_type = other DNA
taacacagctttctatag

SEQ ID NO: 67321 - DNA, 18 bp, synthetic construct
  source 1..18: mol_type = other DNA
taacaccaaacaatctag

SEQ ID NO: 67322 - DNA, 18 bp, synthetic construct
  source 1..18: mol_type = other DNA
taacaccactccttttag

SEQ ID NO: 67323 - DNA, 18 bp, synthetic construct
  source 1..18: mol_type = other DNA
taacacgacaaaatagtg

SEQ ID NO: 67324 - DNA, 18 bp, synthetic construct
  source 1..18: mol_type = other DNA
taacacgacagactaatg

SEQ ID NO: 67325 - DNA, 18 bp, synthetic construct
  source 1..18: mol_type = other DNA
taacacgaccaattattg

SEQ ID NO: 67326 - DNA, 18 bp, synthetic construct
  source 1..18: mol_type = other DNA
taacacgactttcttcgg

SEQ ID NO: 67327 - DNA, 18 bp, synthetic construct
  source 1..18: mol_type = other DNA
taacacgagaatctatag

SEQ ID NO: 67328 - DNA, 18 bp, synthetic construct
  source 1..18: mol_type = other DNA
taacacgataatcgattg

SEQ ID NO: 67329 - DNA, 18 bp, synthetic construct
  source 1..18: mol_type = other DNA
taacacgcaactctaaag

SEQ ID NO: 67330 - DNA, 18 bp, synthetic construct
  source 1..18: mol_type = other DNA
taacacgtctcgctttcg

SEQ ID NO: 67331 - DNA, 18 bp, synthetic construct
  source 1..18: mol_type = other DNA
taacacttctctctaaag

SEQ ID NO: 67332 - DNA, 18 bp, synthetic construct
  source 1..18: mol_type = other DNA
taacacttcttacaacag

SEQ ID NO: 67333 - DNA, 18 bp, synthetic construct
  source 1..18: mol_type = other DNA
taacattattcactattg

SEQ ID NO: 67334 - DNA, 18 bp, synthetic construct
  source 1..18: mol_type = other DNA
taacccgaatcaccaaag

SEQ ID NO: 67335 - DNA, 18 bp, synthetic construct
  source 1..18: mol_type = other DNA
taaccctactcacttttg

SEQ ID NO: 67336 - DNA, 18 bp, synthetic construct
  source 1..18: mol_type = other DNA
taacctgatacactaaag

SEQ ID NO: 67337 - DNA, 18 bp, synthetic construct
  source 1..18: mol_type = other DNA
taacgcgtaactctaaag

SEQ ID NO: 67338 - DNA, 18 bp, synthetic construct
  source 1..18: mol_type = other DNA
taacgctacactctattg

SEQ ID NO: 67339 - DNA, 18 bp, synthetic construct
  source 1..18: mol_type = other DNA
taactaaaatcacaatag

SEQ ID NO: 67340 - DNA, 18 bp, synthetic construct
  source 1..18: mol_type = other DNA
taactcgacacttaatag

SEQ ID NO: 67341 - DNA, 18 bp, synthetic construct
  source 1..18: mol_type = other DNA
taactcgacgcacttcag

SEQ ID NO: 67342 - DNA, 18 bp, synthetic construct
  source 1..18: mol_type = other DNA
taactcgtccaactatag

SEQ ID NO: 67343 - DNA, 18 bp, synthetic construct
  source 1..18: mol_type = other DNA
taactcgtctcacaaaag

SEQ ID NO: 67344 - DNA, 18 bp, synthetic construct
  source 1..18: mol_type = other DNA
taactcgtctcactactg

SEQ ID NO: 67345 - DNA, 18 bp, synthetic construct
  source 1..18: mol_type = other DNA
taactcgttataatgaag

SEQ ID NO: 67346 - DNA, 18 bp, synthetic construct
  source 1..18: mol_type = other DNA
taactctactctcaatag

SEQ ID NO: 67347 - DNA, 18 bp, synthetic construct
  source 1..18: mol_type = other DNA
taagacatcacactatcg

SEQ ID NO: 67348 - DNA, 18 bp, synthetic construct
  source 1..18: mol_type = other DNA
taagacgtcttacttaag

SEQ ID NO: 67349 - DNA, 18 bp, synthetic construct
  source 1..18: mol_type = other DNA
taagaggacacgttatag

SEQ ID NO: 67350 - DNA, 18 bp, synthetic construct
  source 1..18: mol_type = other DNA
taagatgactgacctatg

SEQ ID NO: 67351 - DNA, 18 bp, synthetic construct
  source 1..18: mol_type = other DNA
taaggcgactcgcaagcg

SEQ ID NO: 67352 - DNA, 18 bp, synthetic construct
  source 1..18: mol_type = other DNA
taagtcgattcacttctg

SEQ ID NO: 67353 - DNA, 18 bp, synthetic construct
  source 1..18: mol_type = other DNA
taagtcgcatctcaactg

SEQ ID NO: 67354 - DNA, 18 bp, synthetic construct
  source 1..18: mol_type = other DNA
taagtcgtcatactatgg

SEQ ID NO: 67355 - DNA, 18 bp, synthetic construct
  source 1..18: mol_type = other DNA
taagtcttctctcaatag

SEQ ID NO: 67356 - DNA, 18 bp, synthetic construct
  source 1..18: mol_type = other DNA
taataaaaatcaatttag

SEQ ID NO: 67357 - DNA, 18 bp, synthetic construct
  source 1..18: mol_type = other DNA
taataaaactcggtaaag

SEQ ID NO: 67358 - DNA, 18 bp, synthetic construct
  source 1..18: mol_type = other DNA
taataaatctatctttag

SEQ ID NO: 67359 - DNA, 18 bp, synthetic construct
  source 1..18: mol_type = other DNA
taataacacaaagtatag

SEQ ID NO: 67360 - DNA, 18 bp, synthetic construct
  source 1..18: mol_type = other DNA
taataactccccctcaag

SEQ ID NO: 67361 - DNA, 18 bp, synthetic construct
  source 1..18: mol_type = other DNA
taataagacacactgatg

SEQ ID NO: 67362 - DNA, 18 bp, synthetic construct
  source 1..18: mol_type = other DNA
taataagacactccattg

SEQ ID NO: 67363 - DNA, 18 bp, synthetic construct
  source 1..18: mol_type = other DNA
taataagacactgttaag

SEQ ID NO: 67364 - DNA, 18 bp, synthetic construct
  source 1..18: mol_type = other DNA
taataagaccagcttatg

SEQ ID NO: 67365 - DNA, 18 bp, synthetic construct
  source 1..18: mol_type = other DNA
taataagactcacatagg

SEQ ID NO: 67366 - DNA, 18 bp, synthetic construct
  source 1..18: mol_type = other DNA
taataagattatctttag

SEQ ID NO: 67367 - DNA, 18 bp, synthetic construct
  source 1..18: mol_type = other DNA
taataagattgtcattgg

SEQ ID NO: 67368 - DNA, 18 bp, synthetic construct
  source 1..18: mol_type = other DNA
taataaggcccaatttag

SEQ ID NO: 67369 - DNA, 18 bp, synthetic construct
  source 1..18: mol_type = other DNA
taataagtccatctattg

SEQ ID NO: 67370 - DNA, 18 bp, synthetic construct
  source 1..18: mol_type = other DNA
taataatactcaattaag

SEQ ID NO: 67371 - DNA, 18 bp, synthetic construct
  source 1..18: mol_type = other DNA
taataatatgcactttag

SEQ ID NO: 67372 - DNA, 18 bp, synthetic construct
  source 1..18: mol_type = other DNA
taataattctaacataag

SEQ ID NO: 67373 - DNA, 18 bp, synthetic construct
  source 1..18: mol_type = other DNA
taataattttcacaagtg

SEQ ID NO: 67374 - DNA, 18 bp, synthetic construct
  source 1..18: mol_type = other DNA
taatacaactcagacttg

SEQ ID NO: 67375 - DNA, 18 bp, synthetic construct
  source 1..18: mol_type = other DNA
taatacaactctcatacg

SEQ ID NO: 67376 - DNA, 18 bp, synthetic construct
  source 1..18: mol_type = other DNA
taatacaatatactactg

SEQ ID NO: 67377 - DNA, 18 bp, synthetic construct
  source 1..18: mol_type = other DNA
taatacaatatgctaaag

SEQ ID NO: 67378 - DNA, 18 bp, synthetic construct
  source 1..18: mol_type = other DNA
taatacaattctccattg

SEQ ID NO: 67379 - DNA, 18 bp, synthetic construct
  source 1..18: mol_type = other DNA
taatacaattcttctcgg

SEQ ID NO: 67380 - DNA, 18 bp, synthetic construct
  source 1..18: mol_type = other DNA
taatacatctctatattg

SEQ ID NO: 67381 - DNA, 18 bp, synthetic construct
  source 1..18: mol_type = other DNA
taatacatctgtctacag

SEQ ID NO: 67382 - DNA, 18 bp, synthetic construct
  source 1..18: mol_type = other DNA
taatacatctttctaaag

SEQ ID NO: 67383 - DNA, 18 bp, synthetic construct
  source 1..18: mol_type = other DNA
taataccaatctctgctg

SEQ ID NO: 67384 - DNA, 18 bp, synthetic construct
  source 1..18: mol_type = other DNA
taataccacttaacattg

SEQ ID NO: 67385 - DNA, 18 bp, synthetic construct
  source 1..18: mol_type = other DNA
taatacctataactctag

SEQ ID NO: 67386 - DNA, 18 bp, synthetic construct
  source 1..18: mol_type = other DNA
taataccttacactttag

SEQ ID NO: 67387 - DNA, 18 bp, synthetic construct
  source 1..18: mol_type = other DNA
taatacctttctctattg

SEQ ID NO: 67388 - DNA, 18 bp, synthetic construct
  source 1..18: mol_type = other DNA
taatacgaaaccttttag

SEQ ID NO: 67389 - DNA, 18 bp, synthetic construct
  source 1..18: mol_type = other DNA
taatacgaatccaaattg

SEQ ID NO: 67390 - DNA, 18 bp, synthetic construct
  source 1..18: mol_type = other DNA
taatacgacactcaaccg

SEQ ID NO: 67391 - DNA, 18 bp, synthetic construct
  source 1..18: mol_type = other DNA
taatacgacagacttacg

SEQ ID NO: 67392 - DNA, 18 bp, synthetic construct
  source 1..18: mol_type = other DNA
taatacgacatacatttg

SEQ ID NO: 67393 - DNA, 18 bp, synthetic construct
  source 1..18: mol_type = other DNA
taatacgaccaacaaatg

SEQ ID NO: 67394 - DNA, 18 bp, synthetic construct
  source 1..18: mol_type = other DNA
taatacgacgatctcaag

SEQ ID NO: 67395 - DNA, 18 bp, synthetic construct
  source 1..18: mol_type = other DNA
taatacgactaatcaacg

SEQ ID NO: 67396 - DNA, 18 bp, synthetic construct
  source 1..18: mol_type = other DNA
taatacgacttaaacaag

SEQ ID NO: 67397 - DNA, 18 bp, synthetic construct
  source 1..18: mol_type = other DNA
taatacgacttttaattg

SEQ ID NO: 67398 - DNA, 18 bp, synthetic construct
  source 1..18: mol_type = other DNA
taatacgagaaattattg

SEQ ID NO: 67399 - DNA, 18 bp, synthetic construct
  source 1..18: mol_type = other DNA
taatacgagtcgcacaag

SEQ ID NO: 67400 - DNA, 18 bp, synthetic construct
  source 1..18: mol_type = other DNA
taatacgataccatcaag

SEQ ID NO: 67401 - DNA, 18 bp, synthetic construct
  source 1..18: mol_type = other DNA
taatacgattacttacgg

SEQ ID NO: 67402 - DNA, 18 bp, synthetic construct
  source 1..18: mol_type = other DNA
taatacgattcaattagg

SEQ ID NO: 67403 - DNA, 18 bp, synthetic construct
  source 1..18: mol_type = other DNA
taatacgattcacacatg

SEQ ID NO: 67404 - DNA, 18 bp, synthetic construct
  source 1..18: mol_type = other DNA
taatacgattctatcaag

SEQ ID NO: 67405 - DNA, 18 bp, synthetic construct
  source 1..18: mol_type = other DNA
taatacgattgacggtcg

SEQ ID NO: 67406 - DNA, 18 bp, synthetic construct
  source 1..18: mol_type = other DNA
taatacgattgtatttag

SEQ ID NO: 67407 - DNA, 18 bp, synthetic construct
  source 1..18: mol_type = other DNA
taatacgatttggaattg

SEQ ID NO: 67408 - DNA, 18 bp, synthetic construct
  source 1..18: mol_type = other DNA
taatacgcatcaatttcg

SEQ ID NO: 67409 - DNA, 18 bp, synthetic construct
  source 1..18: mol_type = other DNA
taatacgcatccctttgg

SEQ ID NO: 67410 - DNA, 18 bp, synthetic construct
  source 1..18: mol_type = other DNA
taatacgcatcgttctag

SEQ ID NO: 67411 - DNA, 18 bp, synthetic construct
  source 1..18: mol_type = other DNA
taatacgcctcagccttg

SEQ ID NO: 67412 - DNA, 18 bp, synthetic construct
  source 1..18: mol_type = other DNA
taatacgcgtaactcatg

SEQ ID NO: 67413 - DNA, 18 bp, synthetic construct
  source 1..18: mol_type = other DNA
taatacggcataatgtag

SEQ ID NO: 67414 - DNA, 18 bp, synthetic construct
  source 1..18: mol_type = other DNA
taatacggctgtcgtcag

SEQ ID NO: 67415 - DNA, 18 bp, synthetic construct
  source 1..18: mol_type = other DNA
taatacgtaagtctattg

SEQ ID NO: 67416 - DNA, 18 bp, synthetic construct
  source 1..18: mol_type = other DNA
taatacgtagcaatagag

SEQ ID NO: 67417 - DNA, 18 bp, synthetic construct
  source 1..18: mol_type = other DNA
taatacgtcaaacttaag

SEQ ID NO: 67418 - DNA, 18 bp, synthetic construct
  source 1..18: mol_type = other DNA
taatacgtcacgatgaag

SEQ ID NO: 67419 - DNA, 18 bp, synthetic construct
  source 1..18: mol_type = other DNA
taatacgtccgacttaag

SEQ ID NO: 67420 - DNA, 18 bp, synthetic construct
  source 1..18: mol_type = other DNA
taatacgtcttacactgg

SEQ ID NO: 67421 - DNA, 18 bp, synthetic construct
  source 1..18: mol_type = other DNA
taatacgttgcattatcg

SEQ ID NO: 67422 - DNA, 18 bp, synthetic construct
  source 1..18: mol_type = other DNA
taatacgtttatgattag

SEQ ID NO: 67423 - DNA, 18 bp, synthetic construct
  source 1..18: mol_type = other DNA
taatactaaataatatag

SEQ ID NO: 67424 - DNA, 18 bp, synthetic construct
  source 1..18: mol_type = other DNA
taatactactatagatcg

SEQ ID NO: 67425 - DNA, 18 bp, synthetic construct
  source 1..18: mol_type = other DNA
taatactactcacccgtg

SEQ ID NO: 67426 - DNA, 18 bp, synthetic construct
  source 1..18: mol_type = other DNA
taatactactcatattgg

SEQ ID NO: 67427 - DNA, 18 bp, synthetic construct
  source 1..18: mol_type = other DNA
taatactataataaacag

SEQ ID NO: 67428 - DNA, 18 bp, synthetic construct
  source 1..18: mol_type = other DNA
taatactattctgtattg

SEQ ID NO: 67429 - DNA, 18 bp, synthetic construct
  source 1..18: mol_type = other DNA
taatactcatcactttcg

SEQ ID NO: 67430 - DNA, 18 bp, synthetic construct
  source 1..18: mol_type = other DNA
taatactcctcatcattg

SEQ ID NO: 67431 - DNA, 18 bp, synthetic construct
  source 1..18: mol_type = other DNA
taatactgtattctatag

SEQ ID NO: 67432 - DNA, 18 bp, synthetic construct
  source 1..18: mol_type = other DNA
taatacttcacaccattg

SEQ ID NO: 67433 - DNA, 18 bp, synthetic construct
  source 1..18: mol_type = other DNA
taatacttcccacatttg

SEQ ID NO: 67434 - DNA, 18 bp, synthetic construct
  source 1..18: mol_type = other DNA
taatacttttcaacatag

SEQ ID NO: 67435 - DNA, 18 bp, synthetic construct
  source 1..18: mol_type = other DNA
taatagaactcacatttg

SEQ ID NO: 67436 - DNA, 18 bp, synthetic construct
  source 1..18: mol_type = other DNA
taatagatcacactttag

SEQ ID NO: 67437 - DNA, 18 bp, synthetic construct
  source 1..18: mol_type = other DNA
taatagatctctcgattg

SEQ ID NO: 67438 - DNA, 18 bp, synthetic construct
  source 1..18: mol_type = other DNA
taatagcacatacaatag

SEQ ID NO: 67439 - DNA, 18 bp, synthetic construct
  source 1..18: mol_type = other DNA
taataggaattacttaag

SEQ ID NO: 67440 - DNA, 18 bp, synthetic construct
  source 1..18: mol_type = other DNA
taataggaatttttatag

SEQ ID NO: 67441 - DNA, 18 bp, synthetic construct
  source 1..18: mol_type = other DNA
taataggatacaaaatag

SEQ ID NO: 67442 - DNA, 18 bp, synthetic construct
  source 1..18: mol_type = other DNA
taataggtttcacactag

SEQ ID NO: 67443 - DNA, 18 bp, synthetic construct
  source 1..18: mol_type = other DNA
taatagtccacaggtttg

SEQ ID NO: 67444 - DNA, 18 bp, synthetic construct
  source 1..18: mol_type = other DNA
taatagtcctcttaatag

SEQ ID NO: 67445 - DNA, 18 bp, synthetic construct
  source 1..18: mol_type = other DNA
taatataaatcccgtcag

SEQ ID NO: 67446 - DNA, 18 bp, synthetic construct
  source 1..18: mol_type = other DNA
taatataactggcattcg

SEQ ID NO: 67447 - DNA, 18 bp, synthetic construct
  source 1..18: mol_type = other DNA
taatatcgctctcaatag

SEQ ID NO: 67448 - DNA, 18 bp, synthetic construct
  source 1..18: mol_type = other DNA
taatatctctctttatag

SEQ ID NO: 67449 - DNA, 18 bp, synthetic construct
  source 1..18: mol_type = other DNA
taatatctttcatcatcg

SEQ ID NO: 67450 - DNA, 18 bp, synthetic construct
  source 1..18: mol_type = other DNA
taatatgacacaaaattg

SEQ ID NO: 67451 - DNA, 18 bp, synthetic construct
  source 1..18: mol_type = other DNA
taatatgactctataggg

SEQ ID NO: 67452 - DNA, 18 bp, synthetic construct
  source 1..18: mol_type = other DNA
taatatgattcaccctgg

SEQ ID NO: 67453 - DNA, 18 bp, synthetic construct
  source 1..18: mol_type = other DNA
taatatgcatcagtcaag

SEQ ID NO: 67454 - DNA, 18 bp, synthetic construct
  source 1..18: mol_type = other DNA
taatatgccactctccag

SEQ ID NO: 67455 - DNA, 18 bp, synthetic construct
  source 1..18: mol_type = other DNA
taatatggctttctattg

SEQ ID NO: 67456 - DNA, 18 bp, synthetic construct
  source 1..18: mol_type = other DNA
taatatggctttttctag

SEQ ID NO: 67457 - DNA, 18 bp, synthetic construct
  source 1..18: mol_type = other DNA
taatatgtcgcgttatag

SEQ ID NO: 67458 - DNA, 18 bp, synthetic construct
  source 1..18: mol_type = other DNA
taatattacacattattg

SEQ ID NO: 67459 - DNA, 18 bp, synthetic construct
  source 1..18: mol_type = other DNA
taatcagaaccactttag

SEQ ID NO: 67460 - DNA, 18 bp, synthetic construct
  source 1..18: mol_type = other DNA
taatcagaatctcaatag

SEQ ID NO: 67461 - DNA, 18 bp, synthetic construct
  source 1..18: mol_type = other DNA
taatcagacacagtagag

SEQ ID NO: 67462 - DNA, 18 bp, synthetic construct
  source 1..18: mol_type = other DNA
taatcagactccttatgg

SEQ ID NO: 67463 - DNA, 18 bp, synthetic construct
  source 1..18: mol_type = other DNA
taatcagtttcgctacag

SEQ ID NO: 67464 - DNA, 18 bp, synthetic construct
  source 1..18: mol_type = other DNA
taatcataatcactattg

SEQ ID NO: 67465 - DNA, 18 bp, synthetic construct
  source 1..18: mol_type = other DNA
taatccaaacaactatag

SEQ ID NO: 67466 - DNA, 18 bp, synthetic construct
  source 1..18: mol_type = other DNA
taatccaattgactaatg

SEQ ID NO: 67467 - DNA, 18 bp, synthetic construct
  source 1..18: mol_type = other DNA
taatcccactcatttaag

SEQ ID NO: 67468 - DNA, 18 bp, synthetic construct
  source 1..18: mol_type = other DNA
taatccgaattacaactg

SEQ ID NO: 67469 - DNA, 18 bp, synthetic construct
  source 1..18: mol_type = other DNA
taatccgacttacacaag

SEQ ID NO: 67470 - DNA, 18 bp, synthetic construct
  source 1..18: mol_type = other DNA
taatccgataccaaatag

SEQ ID NO: 67471 - DNA, 18 bp, synthetic construct
  source 1..18: mol_type = other DNA
taatccgattctgtaacg

SEQ ID NO: 67472 - DNA, 18 bp, synthetic construct
  source 1..18: mol_type = other DNA
taatccggctctttaatg

SEQ ID NO: 67473 - DNA, 18 bp, synthetic construct
  source 1..18: mol_type = other DNA
taatccgtccccccatag

SEQ ID NO: 67474 - DNA, 18 bp, synthetic construct
  source 1..18: mol_type = other DNA
taatccgtctcatcttag

SEQ ID NO: 67475 - DNA, 18 bp, synthetic construct
  source 1..18: mol_type = other DNA
taatccgtctcgtattag

SEQ ID NO: 67476 - DNA, 18 bp, synthetic construct
  source 1..18: mol_type = other DNA
taatccgtcttagcttcg

SEQ ID NO: 67477 - DNA, 18 bp, synthetic construct
  source 1..18: mol_type = other DNA
taatcctaccctttttag

SEQ ID NO: 67478 - DNA, 18 bp, synthetic construct
  source 1..18: mol_type = other DNA
taatcctactcacaaacg

SEQ ID NO: 67479 - DNA, 18 bp, synthetic construct
  source 1..18: mol_type = other DNA
taatcctattcacaatcg

SEQ ID NO: 67480 - DNA, 18 bp, synthetic construct
  source 1..18: mol_type = other DNA
taatctgacacacttctg

SEQ ID NO: 67481 - DNA, 18 bp, synthetic construct
  source 1..18: mol_type = other DNA
taatgcaaattactacag

SEQ ID NO: 67482 - DNA, 18 bp, synthetic construct
  source 1..18: mol_type = other DNA
taatgcaacttgctttag

SEQ ID NO: 67483 - DNA, 18 bp, synthetic construct
  source 1..18: mol_type = other DNA
taatgcatctcattttag

SEQ ID NO: 67484 - DNA, 18 bp, synthetic construct
  source 1..18: mol_type = other DNA
taatgccaataactattg

SEQ ID NO: 67485 - DNA, 18 bp, synthetic construct
  source 1..18: mol_type = other DNA
taatgccacctactattg

SEQ ID NO: 67486 - DNA, 18 bp, synthetic construct
  source 1..18: mol_type = other DNA
taatgcggctcactcatg

SEQ ID NO: 67487 - DNA, 18 bp, synthetic construct
  source 1..18: mol_type = other DNA
taatgcggctctctgttg

SEQ ID NO: 67488 - DNA, 18 bp, synthetic construct
  source 1..18: mol_type = other DNA
taatgcggtactcaatag

SEQ ID NO: 67489 - DNA, 18 bp, synthetic construct
  source 1..18: mol_type = other DNA
taatgcggttcaatattg

SEQ ID NO: 67490 - DNA, 18 bp, synthetic construct
  source 1..18: mol_type = other DNA
taatgcgtcccccttttg

SEQ ID NO: 67491 - DNA, 18 bp, synthetic construct
  source 1..18: mol_type = other DNA
taatgctttacactatag

SEQ ID NO: 67492 - DNA, 18 bp, synthetic construct
  source 1..18: mol_type = other DNA
taatgggtttctttattg

SEQ ID NO: 67493 - DNA, 18 bp, synthetic construct
  source 1..18: mol_type = other DNA
taattaaactcattgtag

SEQ ID NO: 67494 - DNA, 18 bp, synthetic construct
  source 1..18: mol_type = other DNA
taattacaatcactaaag

SEQ ID NO: 67495 - DNA, 18 bp, synthetic construct
  source 1..18: mol_type = other DNA
taattagacgctctatgg

SEQ ID NO: 67496 - DNA, 18 bp, synthetic construct
  source 1..18: mol_type = other DNA
taattagactcatattag

SEQ ID NO: 67497 - DNA, 18 bp, synthetic construct
  source 1..18: mol_type = other DNA
taattagtcgaactatag

SEQ ID NO: 67498 - DNA, 18 bp, synthetic construct
  source 1..18: mol_type = other DNA
taattagtctttctatag

SEQ ID NO: 67499 - DNA, 18 bp, synthetic construct
  source 1..18: mol_type = other DNA
taattagtgcccgtaatg

SEQ ID NO: 67500 - DNA, 18 bp, synthetic construct
  source 1..18: mol_type = other DNA
taattagtttcactttag

SEQ ID NO: 67501 - DNA, 18 bp, synthetic construct
  source 1..18: mol_type = other DNA
taattatactcagtattg

SEQ ID NO: 67502 - DNA, 18 bp, synthetic construct
  source 1..18: mol_type = other DNA
taattcaacacacttaag

SEQ ID NO: 67503 - DNA, 18 bp, synthetic construct
  source 1..18: mol_type = other DNA
taattcaactcaaaattg

SEQ ID NO: 67504 - DNA, 18 bp, synthetic construct
  source 1..18: mol_type = other DNA
taattcaactcaacgaag

SEQ ID NO: 67505 - DNA, 18 bp, synthetic construct
  source 1..18: mol_type = other DNA
taattcaactttcttttg

SEQ ID NO: 67506 - DNA, 18 bp, synthetic construct
  source 1..18: mol_type = other DNA
taattcaattctcaatag

SEQ ID NO: 67507 - DNA, 18 bp, synthetic construct
  source 1..18: mol_type = other DNA
taattcaattctccaaag

SEQ ID NO: 67508 - DNA, 18 bp, synthetic construct
  source 1..18: mol_type = other DNA
taattcacctatcaaaag

SEQ ID NO: 67509 - DNA, 18 bp, synthetic construct
  source 1..18: mol_type = other DNA
taattcatctcgccatag

SEQ ID NO: 67510 - DNA, 18 bp, synthetic construct
  source 1..18: mol_type = other DNA
taattcatctgactgtag

SEQ ID NO: 67511 - DNA, 18 bp, synthetic construct
  source 1..18: mol_type = other DNA
taattccaatcattattg

SEQ ID NO: 67512 - DNA, 18 bp, synthetic construct
  source 1..18: mol_type = other DNA
taattccactctctgttg

SEQ ID NO: 67513 - DNA, 18 bp, synthetic construct
  source 1..18: mol_type = other DNA
taattcccctcacaattg

SEQ ID NO: 67514 - DNA, 18 bp, synthetic construct
  source 1..18: mol_type = other DNA
taattcccctgaccaatg

SEQ ID NO: 67515 - DNA, 18 bp, synthetic construct
  source 1..18: mol_type = other DNA
taattccgcacacttttg

SEQ ID NO: 67516 - DNA, 18 bp, synthetic construct
  source 1..18: mol_type = other DNA
taattcgaaggacaatag

SEQ ID NO: 67517 - DNA, 18 bp, synthetic construct
  source 1..18: mol_type = other DNA
taattcgaatcttccatg

SEQ ID NO: 67518 - DNA, 18 bp, synthetic construct
  source 1..18: mol_type = other DNA
taattcgacaaagtgtag

SEQ ID NO: 67519 - DNA, 18 bp, synthetic construct
  source 1..18: mol_type = other DNA
taattcgacaattacggg

SEQ ID NO: 67520 - DNA, 18 bp, synthetic construct
  source 1..18: mol_type = other DNA
taattcgacacactttta

SEQ ID NO: 67521 - DNA, 18 bp, synthetic construct
  source 1..18: mol_type = other DNA
taattcgaccaacactag

SEQ ID NO: 67522 - DNA, 18 bp, synthetic construct
  source 1..18: mol_type = other DNA
taattcgacccgcttaag

SEQ ID NO: 67523 - DNA, 18 bp, synthetic construct
  source 1..18: mol_type = other DNA
taattcgacgcacatcag

SEQ ID NO: 67524 - DNA, 18 bp, synthetic construct
  source 1..18: mol_type = other DNA
taattcgactctcacgtg

SEQ ID NO: 67525 - DNA, 18 bp, synthetic construct
  source 1..18: mol_type = other DNA
taattcgactgacaaatg

SEQ ID NO: 67526 - DNA, 18 bp, synthetic construct
  source 1..18: mol_type = other DNA
taattcgagttatgaaag

SEQ ID NO: 67527 - DNA, 18 bp, synthetic construct
  source 1..18: mol_type = other DNA
taattcgccttaccaaag

SEQ ID NO: 67528 - DNA, 18 bp, synthetic construct
  source 1..18: mol_type = other DNA
taattcgtatcacatgag

SEQ ID NO: 67529 - DNA, 18 bp, synthetic construct
  source 1..18: mol_type = other DNA
taattcgtatcagtatcg

SEQ ID NO: 67530 - DNA, 18 bp, synthetic construct
  source 1..18: mol_type = other DNA
taattcgtctttcaatag

SEQ ID NO: 67531 - DNA, 18 bp, synthetic construct
  source 1..18: mol_type = other DNA
taattcgtttatttatag

SEQ ID NO: 67532 - DNA, 18 bp, synthetic construct
  source 1..18: mol_type = other DNA
taattcgtttcacacttg

SEQ ID NO: 67533 - DNA, 18 bp, synthetic construct
  source 1..18: mol_type = other DNA
taattctaaacacaatag

SEQ ID NO: 67534 - DNA, 18 bp, synthetic construct
  source 1..18: mol_type = other DNA
taattctaatcactactg

SEQ ID NO: 67535 - DNA, 18 bp, synthetic construct
  source 1..18: mol_type = other DNA
taattctaatccctatgg

SEQ ID NO: 67536 - DNA, 18 bp, synthetic construct
  source 1..18: mol_type = other DNA
taattctacataccatgg

SEQ ID NO: 67537 - DNA, 18 bp, synthetic construct
  source 1..18: mol_type = other DNA
taattcttcgctctatag

SEQ ID NO: 67538 - DNA, 18 bp, synthetic construct
  source 1..18: mol_type = other DNA
taattgctctcactaaag

SEQ ID NO: 67539 - DNA, 18 bp, synthetic construct
  source 1..18: mol_type = other DNA
taattggattcacaatgg

SEQ ID NO: 67540 - DNA, 18 bp, synthetic construct
  source 1..18: mol_type = other DNA
taattgtactctttatag

SEQ ID NO: 67541 - DNA, 18 bp, synthetic construct
  source 1..18: mol_type = other DNA
taattgtattcgctatag

SEQ ID NO: 67542 - DNA, 18 bp, synthetic construct
  source 1..18: mol_type = other DNA
taatttaacacacaattg

SEQ ID NO: 67543 - DNA, 18 bp, synthetic construct
  source 1..18: mol_type = other DNA
taatttaacacactattg

SEQ ID NO: 67544 - DNA, 18 bp, synthetic construct
  source 1..18: mol_type = other DNA
taatttgacttccagtag

SEQ ID NO: 67545 - DNA, 18 bp, synthetic construct
  source 1..18: mol_type = other DNA
taatttgatagactattg

SEQ ID NO: 67546 - DNA, 18 bp, synthetic construct
  source 1..18: mol_type = other DNA
taatttgattggctatag

SEQ ID NO: 67547 - DNA, 18 bp, synthetic construct
  source 1..18: mol_type = other DNA
taatttgtcacacgatag

SEQ ID NO: 67548 - DNA, 18 bp, synthetic construct
  source 1..18: mol_type = other DNA
tacaaaaacaatctttag

SEQ ID NO: 67549 - DNA, 18 bp, synthetic construct
  source 1..18: mol_type = other DNA
tacaaccactctctgaag

SEQ ID NO: 67550 - DNA, 18 bp, synthetic construct
  source 1..18: mol_type = other DNA
tacaaccgctccctatag

SEQ ID NO: 67551 - DNA, 18 bp, synthetic construct
  source 1..18: mol_type = other DNA
tacaaccgcttactttag

SEQ ID NO: 67552 - DNA, 18 bp, synthetic construct
  source 1..18: mol_type = other DNA
tacaacgactcatcattg

SEQ ID NO: 67553 - DNA, 18 bp, synthetic construct
  source 1..18: mol_type = other DNA
tacaacgactctacattg

SEQ ID NO: 67554 - DNA, 18 bp, synthetic construct
  source 1..18: mol_type = other DNA
tacaacgtatccccatag

SEQ ID NO: 67555 - DNA, 18 bp, synthetic construct
  source 1..18: mol_type = other DNA
tacaacgtctcaataaag

SEQ ID NO: 67556 - DNA, 18 bp, synthetic construct
  source 1..18: mol_type = other DNA
tacaactactcacttttg

SEQ ID NO: 67557 - DNA, 18 bp, synthetic construct
  source 1..18: mol_type = other DNA
tacaactattcactaaag

SEQ ID NO: 67558 - DNA, 18 bp, synthetic construct
  source 1..18: mol_type = other DNA
tacaattactccctatag

SEQ ID NO: 67559 - DNA, 18 bp, synthetic construct
  source 1..18: mol_type = other DNA
tacaccgagtcaatatgg

SEQ ID NO: 67560 - DNA, 18 bp, synthetic construct
  source 1..18: mol_type = other DNA
tacactgactccctaaag

SEQ ID NO: 67561 - DNA, 18 bp, synthetic construct
  source 1..18: mol_type = other DNA
tacatccacttactttag

SEQ ID NO: 67562 - DNA, 18 bp, synthetic construct
  source 1..18: mol_type = other DNA
tacatcgactcacttaag

SEQ ID NO: 67563 - DNA, 18 bp, synthetic construct
  source 1..18: mol_type = other DNA
tacatcgattctctattg

SEQ ID NO: 67564 - DNA, 18 bp, synthetic construct
  source 1..18: mol_type = other DNA
tacattggcttattttag

SEQ ID NO: 67565 - DNA, 18 bp, synthetic construct
  source 1..18: mol_type = other DNA
taccacgaatctatatag

SEQ ID NO: 67566 - DNA, 18 bp, synthetic construct
  source 1..18: mol_type = other DNA
taccacgactcgcgttag

SEQ ID NO: 67567 - DNA, 18 bp, synthetic construct
  source 1..18: mol_type = other DNA
taccatgattaaagatag

SEQ ID NO: 67568 - DNA, 18 bp, synthetic construct
  source 1..18: mol_type = other DNA
taccgcgattgtctaaag

SEQ ID NO: 67569 - DNA, 18 bp, synthetic construct
  source 1..18: mol_type = other DNA
tacctcgatacatttgag

SEQ ID NO: 67570 - DNA, 18 bp, synthetic construct
  source 1..18: mol_type = other DNA
tacctcgtctcattatag

SEQ ID NO: 67571 - DNA, 18 bp, synthetic construct
  source 1..18: mol_type = other DNA
tactaaaacagactatag

SEQ ID NO: 67572 - DNA, 18 bp, synthetic construct
  source 1..18: mol_type = other DNA
tactaatgttcacaatag

SEQ ID NO: 67573 - DNA, 18 bp, synthetic construct
  source 1..18: mol_type = other DNA
tactacaaatcttttaag

SEQ ID NO: 67574 - DNA, 18 bp, synthetic construct
  source 1..18: mol_type = other DNA
tactacaacacaatattg

SEQ ID NO: 67575 - DNA, 18 bp, synthetic construct
  source 1..18: mol_type = other DNA
tactacaacccactaagg

SEQ ID NO: 67576 - DNA, 18 bp, synthetic construct
  source 1..18: mol_type = other DNA
tactacatcacacgctag

SEQ ID NO: 67577 - DNA, 18 bp, synthetic construct
  source 1..18: mol_type = other DNA
tactaccactcagagtag

SEQ ID NO: 67578 - DNA, 18 bp, synthetic construct
  source 1..18: mol_type = other DNA
tactaccgcaaactatag

SEQ ID NO: 67579 - DNA, 18 bp, synthetic construct
  source 1..18: mol_type = other DNA
tactacgaacttctatag

SEQ ID NO: 67580 - DNA, 18 bp, synthetic construct
  source 1..18: mol_type = other DNA
tactacgaatatctatgg

SEQ ID NO: 67581 - DNA, 18 bp, synthetic construct
  source 1..18: mol_type = other DNA
tactacgaattacttcag

SEQ ID NO: 67582 - DNA, 18 bp, synthetic construct
  source 1..18: mol_type = other DNA
tactacgacccaacaatg

SEQ ID NO: 67583 - DNA, 18 bp, synthetic construct
  source 1..18: mol_type = other DNA
tactacggaacactatcg

SEQ ID NO: 67584 - DNA, 18 bp, synthetic construct
  source 1..18: mol_type = other DNA
tactacgtcaaactttag

SEQ ID NO: 67585 - DNA, 18 bp, synthetic construct
  source 1..18: mol_type = other DNA
tactactattccctgatg

SEQ ID NO: 67586 - DNA, 18 bp, synthetic construct
  source 1..18: mol_type = other DNA
tactaggacatactttcg

SEQ ID NO: 67587 - DNA, 18 bp, synthetic construct
  source 1..18: mol_type = other DNA
tactatatcacactaaag

SEQ ID NO: 67588 - DNA, 18 bp, synthetic construct
  source 1..18: mol_type = other DNA
tactatgtctcgcgatag

SEQ ID NO: 67589 - DNA, 18 bp, synthetic construct
  source 1..18: mol_type = other DNA
tactccgtcacaatatag

SEQ ID NO: 67590 - DNA, 18 bp, synthetic construct
  source 1..18: mol_type = other DNA
tactgcgtttctttttgg

SEQ ID NO: 67591 - DNA, 18 bp, synthetic construct
  source 1..18: mol_type = other DNA
tacttccactcataatag

SEQ ID NO: 67592 - DNA, 18 bp, synthetic construct
  source 1..18: mol_type = other DNA
tacttcgactctgtatgg

SEQ ID NO: 67593 - DNA, 18 bp, synthetic construct
  source 1..18: mol_type = other DNA
tacttcgatactccatag

SEQ ID NO: 67594 - DNA, 18 bp, synthetic construct
  source 1..18: mol_type = other DNA
tacttcgtcactctaacg

SEQ ID NO: 67595 - DNA, 18 bp, synthetic construct
  source 1..18: mol_type = other DNA
tacttcttatcactatag

SEQ ID NO: 67596 - DNA, 18 bp, synthetic construct
  source 1..18: mol_type = other DNA
tagaaccacatggaattg

SEQ ID NO: 67597 - DNA, 18 bp, synthetic construct
  source 1..18: mol_type = other DNA
tagaacgattcacttttg

SEQ ID NO: 67598 - DNA, 18 bp, synthetic construct
  source 1..18: mol_type = other DNA
tagaacgtctcaataaag

SEQ ID NO: 67599 - DNA, 18 bp, synthetic construct
  source 1..18: mol_type = other DNA
tagaacgtctctttaaag

SEQ ID NO: 67600 - DNA, 18 bp, synthetic construct
  source 1..18: mol_type = other DNA
tagaactactcaaagttg

SEQ ID NO: 67601 - DNA, 18 bp, synthetic construct
  source 1..18: mol_type = other DNA
tagacttactcatttttg

SEQ ID NO: 67602 - DNA, 18 bp, synthetic construct
  source 1..18: mol_type = other DNA
tagatcgctttacttaag

SEQ ID NO: 67603 - DNA, 18 bp, synthetic construct
  source 1..18: mol_type = other DNA
tagcacgtctcacatacg

SEQ ID NO: 67604 - DNA, 18 bp, synthetic construct
  source 1..18: mol_type = other DNA
tagcactacttactttag

SEQ ID NO: 67605 - DNA, 18 bp, synthetic construct
  source 1..18: mol_type = other DNA
tagcatgactcattctag

SEQ ID NO: 67606 - DNA, 18 bp, synthetic construct
  source 1..18: mol_type = other DNA
tagcttgacacactatag

SEQ ID NO: 67607 - DNA, 18 bp, synthetic construct
  source 1..18: mol_type = other DNA
taggaggactgacttatg

SEQ ID NO: 67608 - DNA, 18 bp, synthetic construct
  source 1..18: mol_type = other DNA
taggcctacttaatgtag

SEQ ID NO: 67609 - DNA, 18 bp, synthetic construct
  source 1..18: mol_type = other DNA
tagtaagagccactgatg

SEQ ID NO: 67610 - DNA, 18 bp, synthetic construct
  source 1..18: mol_type = other DNA
tagtaagtctcacttttg

SEQ ID NO: 67611 - DNA, 18 bp, synthetic construct
  source 1..18: mol_type = other DNA
tagtacaacacacaattg

SEQ ID NO: 67612 - DNA, 18 bp, synthetic construct
  source 1..18: mol_type = other DNA
tagtacaacccaccaaag

SEQ ID NO: 67613 - DNA, 18 bp, synthetic construct
  source 1..18: mol_type = other DNA
tagtacaactctctgaag

SEQ ID NO: 67614 - DNA, 18 bp, synthetic construct
  source 1..18: mol_type = other DNA
tagtacaattccctaaag

SEQ ID NO: 67615 - DNA, 18 bp, synthetic construct
  source 1..18: mol_type = other DNA
tagtacatctcacattag

SEQ ID NO: 67616 - DNA, 18 bp, synthetic construct
  source 1..18: mol_type = other DNA
tagtaccactccgtacag

SEQ ID NO: 67617 - DNA, 18 bp, synthetic construct
  source 1..18: mol_type = other DNA
tagtaccatttccttcgg

SEQ ID NO: 67618 - DNA, 18 bp, synthetic construct
  source 1..18: mol_type = other DNA
tagtacgaaacaatacag

SEQ ID NO: 67619 - DNA, 18 bp, synthetic construct
  source 1..18: mol_type = other DNA
tagtacgaatgtcaatag

SEQ ID NO: 67620 - DNA, 18 bp, synthetic construct
  source 1..18: mol_type = other DNA
tagtacgacatacaatgg

SEQ ID NO: 67621 - DNA, 18 bp, synthetic construct
  source 1..18: mol_type = other DNA
tagtacgtctatctttag

SEQ ID NO: 67622 - DNA, 18 bp, synthetic construct
  source 1..18: mol_type = other DNA
tagtacgtcttacttttg

SEQ ID NO: 67623 - DNA, 18 bp, synthetic construct
  source 1..18: mol_type = other DNA
tagtacgtgtcaacatag

SEQ ID NO: 67624 - DNA, 18 bp, synthetic construct
  source 1..18: mol_type = other DNA
tagtacgttactaaaatg

SEQ ID NO: 67625 - DNA, 18 bp, synthetic construct
  source 1..18: mol_type = other DNA
tagtacgttactttatag

SEQ ID NO: 67626 - DNA, 18 bp, synthetic construct
  source 1..18: mol_type = other DNA
tagtactactcattgttg

SEQ ID NO: 67627 - DNA, 18 bp, synthetic construct
  source 1..18: mol_type = other DNA
tagtactactctgtatgg

SEQ ID NO: 67628 - DNA, 18 bp, synthetic construct
  source 1..18: mol_type = other DNA
tagtaggacccactaacg

SEQ ID NO: 67629 - DNA, 18 bp, synthetic construct
  source 1..18: mol_type = other DNA
tagtaggactcacatgag

SEQ ID NO: 67630 - DNA, 18 bp, synthetic construct
  source 1..18: mol_type = other DNA
tagtaggtttctctacag

SEQ ID NO: 67631 - DNA, 18 bp, synthetic construct
  source 1..18: mol_type = other DNA
tagtataactcgctattg

SEQ ID NO: 67632 - DNA, 18 bp, synthetic construct
  source 1..18: mol_type = other DNA
tagtgcgtctctattttg

SEQ ID NO: 67633 - DNA, 18 bp, synthetic construct
  source 1..18: mol_type = other DNA
tagttcaacacgttaaag

SEQ ID NO: 67634 - DNA, 18 bp, synthetic construct
  source 1..18: mol_type = other DNA
tagttcgacttataaaag

SEQ ID NO: 67635 - DNA, 18 bp, synthetic construct
  source 1..18: mol_type = other DNA
tagttcgatcccctatag

SEQ ID NO: 67636 - DNA, 18 bp, synthetic construct
  source 1..18: mol_type = other DNA
tagttctactccctgtag

SEQ ID NO: 67637 - DNA, 18 bp, synthetic construct
  source 1..18: mol_type = other DNA
tagtttcattcactctag

SEQ ID NO: 67638 - DNA, 18 bp, synthetic construct
  source 1..18: mol_type = other DNA
tagtttgacacattatag

SEQ ID NO: 67639 - DNA, 18 bp, synthetic construct
  source 1..18: mol_type = other DNA
tataacgaaagtctaaag

SEQ ID NO: 67640 - DNA, 18 bp, synthetic construct
  source 1..18: mol_type = other DNA
tataacgacaatccagag

SEQ ID NO: 67641 - DNA, 18 bp, synthetic construct
  source 1..18: mol_type = other DNA
tataacgactccttttag

SEQ ID NO: 67642 - DNA, 18 bp, synthetic construct
  source 1..18: mol_type = other DNA
tataacgagtcacaatcg

SEQ ID NO: 67643 - DNA, 18 bp, synthetic construct
  source 1..18: mol_type = other DNA
tataacgagtcaccaaag

SEQ ID NO: 67644 - DNA, 18 bp, synthetic construct
  source 1..18: mol_type = other DNA
tataacgagtttctaaag

SEQ ID NO: 67645 - DNA, 18 bp, synthetic construct
  source 1..18: mol_type = other DNA
tataacgatacactctag

SEQ ID NO: 67646 - DNA, 18 bp, synthetic construct
  source 1..18: mol_type = other DNA
tataacgcatccctttag

SEQ ID NO: 67647 - DNA, 18 bp, synthetic construct
  source 1..18: mol_type = other DNA
tataacgcatctctatag

SEQ ID NO: 67648 - DNA, 18 bp, synthetic construct
  source 1..18: mol_type = other DNA
tataacggctccctatcg

SEQ ID NO: 67649 - DNA, 18 bp, synthetic construct
  source 1..18: mol_type = other DNA
tataacgggtgaatgtag

SEQ ID NO: 67650 - DNA, 18 bp, synthetic construct
  source 1..18: mol_type = other DNA
tataacgtctaacaatgg

SEQ ID NO: 67651 - DNA, 18 bp, synthetic construct
  source 1..18: mol_type = other DNA
tataacgtctaactttag

SEQ ID NO: 67652 - DNA, 18 bp, synthetic construct
  source 1..18: mol_type = other DNA
tataacgtctctctttag

SEQ ID NO: 67653 - DNA, 18 bp, synthetic construct
  source 1..18: mol_type = other DNA
tataattactcgctctag

SEQ ID NO: 67654 - DNA, 18 bp, synthetic construct
  source 1..18: mol_type = other DNA
tatacagactcactttag

SEQ ID NO: 67655 - DNA, 18 bp, synthetic construct
  source 1..18: mol_type = other DNA
tatacccactgactaaag

SEQ ID NO: 67656 - DNA, 18 bp, synthetic construct
  source 1..18: mol_type = other DNA
tatagggacacactgtag

SEQ ID NO: 67657 - DNA, 18 bp, synthetic construct
  source 1..18: mol_type = other DNA
tatagtgtcatactacag

SEQ ID NO: 67658 - DNA, 18 bp, synthetic construct
  source 1..18: mol_type = other DNA
tatatcaactcacaatag

SEQ ID NO: 67659 - DNA, 18 bp, synthetic construct
  source 1..18: mol_type = other DNA
tatatcgacacactatcg

SEQ ID NO: 67660 - DNA, 18 bp, synthetic construct
  source 1..18: mol_type = other DNA
tatatcgtctaactttag

SEQ ID NO: 67661 - DNA, 18 bp, synthetic construct
  source 1..18: mol_type = other DNA
tatatcgtctcgttatcg

SEQ ID NO: 67662 - DNA, 18 bp, synthetic construct
  source 1..18: mol_type = other DNA
tatcacaactcatggaag

SEQ ID NO: 67663 - DNA, 18 bp, synthetic construct
  source 1..18: mol_type = other DNA
tatcacgacgctctaaag

SEQ ID NO: 67664 - DNA, 18 bp, synthetic construct
  source 1..18: mol_type = other DNA
tatcacgactcattacgg

SEQ ID NO: 67665 - DNA, 18 bp, synthetic construct
  source 1..18: mol_type = other DNA
tatcacgattcaacatag

SEQ ID NO: 67666 - DNA, 18 bp, synthetic construct
  source 1..18: mol_type = other DNA
tatcacgtctcacaacag

SEQ ID NO: 67667 - DNA, 18 bp, synthetic construct
  source 1..18: mol_type = other DNA
tatcactactcacactag

SEQ ID NO: 67668 - DNA, 18 bp, synthetic construct
  source 1..18: mol_type = other DNA
tatcatgcctaaatatag

SEQ ID NO: 67669 - DNA, 18 bp, synthetic construct
  source 1..18: mol_type = other DNA
tatcccgactttctatag

SEQ ID NO: 67670 - DNA, 18 bp, synthetic construct
  source 1..18: mol_type = other DNA
tatcgctaatcacaaaag

SEQ ID NO: 67671 - DNA, 18 bp, synthetic construct
  source 1..18: mol_type = other DNA
tatcgctactcattgacg

SEQ ID NO: 67672 - DNA, 18 bp, synthetic construct
  source 1..18: mol_type = other DNA
tatgactactccctttag

SEQ ID NO: 67673 - DNA, 18 bp, synthetic construct
  source 1..18: mol_type = other DNA
tatgacttctcactttag

SEQ ID NO: 67674 - DNA, 18 bp, synthetic construct
  source 1..18: mol_type = other DNA
tatgatgtctcacaaaag

SEQ ID NO: 67675 - DNA, 18 bp, synthetic construct
  source 1..18: mol_type = other DNA
tattaaatctcaccatag

SEQ ID NO: 67676 - DNA, 18 bp, synthetic construct
  source 1..18: mol_type = other DNA
tattaacactaacaatag

SEQ ID NO: 67677 - DNA, 18 bp, synthetic construct
  source 1..18: mol_type = other DNA
tattaacactcaccttag

SEQ ID NO: 67678 - DNA, 18 bp, synthetic construct
  source 1..18: mol_type = other DNA
tattaacattccctatag

SEQ ID NO: 67679 - DNA, 18 bp, synthetic construct
  source 1..18: mol_type = other DNA
tattaagacttataatag

SEQ ID NO: 67680 - DNA, 18 bp, synthetic construct
  source 1..18: mol_type = other DNA
tattaagagtctatataa

SEQ ID NO: 67681 - DNA, 18 bp, synthetic construct
  source 1..18: mol_type = other DNA
tattaagcctaacaaccg

SEQ ID NO: 67682 - DNA, 18 bp, synthetic construct
  source 1..18: mol_type = other DNA
tattaagtctcactcttg

SEQ ID NO: 67683 - DNA, 18 bp, synthetic construct
  source 1..18: mol_type = other DNA
tattaagtctcccttgag

SEQ ID NO: 67684 - DNA, 18 bp, synthetic construct
  source 1..18: mol_type = other DNA
tattaatactcaatattg

SEQ ID NO: 67685 - DNA, 18 bp, synthetic construct
  source 1..18: mol_type = other DNA
tattaatacttgcaaaag

SEQ ID NO: 67686 - DNA, 18 bp, synthetic construct
  source 1..18: mol_type = other DNA
tattaatgttcactttag

SEQ ID NO: 67687 - DNA, 18 bp, synthetic construct
  source 1..18: mol_type = other DNA
tattaattctcacaatgg

SEQ ID NO: 67688 - DNA, 18 bp, synthetic construct
  source 1..18: mol_type = other DNA
tattaattctctctaaag

SEQ ID NO: 67689 - DNA, 18 bp, synthetic construct
  source 1..18: mol_type = other DNA
tattacaaatctctaaag

SEQ ID NO: 67690 - DNA, 18 bp, synthetic construct
  source 1..18: mol_type = other DNA
tattacaacacactactg

SEQ ID NO: 67691 - DNA, 18 bp, synthetic construct
  source 1..18: mol_type = other DNA
tattacaactaacaaaag

SEQ ID NO: 67692 - DNA, 18 bp, synthetic construct
  source 1..18: mol_type = other DNA
tattacaatacactttag

SEQ ID NO: 67693 - DNA, 18 bp, synthetic construct
  source 1..18: mol_type = other DNA
tattacaattaagtatag

SEQ ID NO: 67694 - DNA, 18 bp, synthetic construct
  source 1..18: mol_type = other DNA
tattaccacccccaatgg

SEQ ID NO: 67695 - DNA, 18 bp, synthetic construct
  source 1..18: mol_type = other DNA
tattaccatttaccttcg

SEQ ID NO: 67696 - DNA, 18 bp, synthetic construct
  source 1..18: mol_type = other DNA
tattacctcgccctaaag

SEQ ID NO: 67697 - DNA, 18 bp, synthetic construct
  source 1..18: mol_type = other DNA
tattacctttcacaatag

SEQ ID NO: 67698 - DNA, 18 bp, synthetic construct
  source 1..18: mol_type = other DNA
tattacgaatctcttatg

SEQ ID NO: 67699 - DNA, 18 bp, synthetic construct
  source 1..18: mol_type = other DNA
tattacgacaagctattg

SEQ ID NO: 67700 - DNA, 18 bp, synthetic construct
  source 1..18: mol_type = other DNA
tattacgacacattcttg

SEQ ID NO: 67701 - DNA, 18 bp, synthetic construct
  source 1..18: mol_type = other DNA
tattacgacacgcggatg

SEQ ID NO: 67702 - DNA, 18 bp, synthetic construct
  source 1..18: mol_type = other DNA
tattacgacactctgttg

SEQ ID NO: 67703 - DNA, 18 bp, synthetic construct
  source 1..18: mol_type = other DNA
tattacgacattctattg

SEQ ID NO: 67704 - DNA, 18 bp, synthetic construct
  source 1..18: mol_type = other DNA
tattacgactctttgtcg

SEQ ID NO: 67705 - DNA, 18 bp, synthetic construct
  source 1..18: mol_type = other DNA
tattacgagctacttcag

SEQ ID NO: 67706 - DNA, 18 bp, synthetic construct
  source 1..18: mol_type = other DNA
tattacgagtctcacttg

SEQ ID NO: 67707 - DNA, 18 bp, synthetic construct
  source 1..18: mol_type = other DNA
tattacgcctaacttttg

SEQ ID NO: 67708 - DNA, 18 bp, synthetic construct
  source 1..18: mol_type = other DNA
tattacgcctcagaattg

SEQ ID NO: 67709 - DNA, 18 bp, synthetic construct
  source 1..18: mol_type = other DNA
tattacggctcacctcag

SEQ ID NO: 67710 - DNA, 18 bp, synthetic construct
  source 1..18: mol_type = other DNA
tattacgtaacacttttg

SEQ ID NO: 67711 - DNA, 18 bp, synthetic construct
  source 1..18: mol_type = other DNA
tattacgtatcactgttg

SEQ ID NO: 67712 - DNA, 18 bp, synthetic construct
  source 1..18: mol_type = other DNA
tattacgtcatattatag

SEQ ID NO: 67713 - DNA, 18 bp, synthetic construct
  source 1..18: mol_type = other DNA
tattacgtcattatatag

SEQ ID NO: 67714 - DNA, 18 bp, synthetic construct
  source 1..18: mol_type = other DNA
tattacgtttcacataag

SEQ ID NO: 67715 - DNA, 18 bp, synthetic construct
  source 1..18: mol_type = other DNA
tattacgtttcccttatg

SEQ ID NO: 67716 - DNA, 18 bp, synthetic construct
  source 1..18: mol_type = other DNA
tattactacacagtatcg

SEQ ID NO: 67717 - DNA, 18 bp, synthetic construct
  source 1..18: mol_type = other DNA
tattactactctcgatcg

SEQ ID NO: 67718 - DNA, 18 bp, synthetic construct
  source 1..18: mol_type = other DNA
tattactatacactgaag

SEQ ID NO: 67719 - DNA, 18 bp, synthetic construct
  source 1..18: mol_type = other DNA
tattactcctctctattg

SEQ ID NO: 67720 - DNA, 18 bp, synthetic construct
  source 1..18: mol_type = other DNA
tattactgctctcaataa

SEQ ID NO: 67721 - DNA, 18 bp, synthetic construct
  source 1..18: mol_type = other DNA
tattactgttcactgtag

SEQ ID NO: 67722 - DNA, 18 bp, synthetic construct
  source 1..18: mol_type = other DNA
tattacttcgtactgtag

SEQ ID NO: 67723 - DNA, 18 bp, synthetic construct
  source 1..18: mol_type = other DNA
tattacttctccctgtag

SEQ ID NO: 67724 - DNA, 18 bp, synthetic construct
  source 1..18: mol_type = other DNA
tattacttctctctctag

SEQ ID NO: 67725 - DNA, 18 bp, synthetic construct
  source 1..18: mol_type = other DNA
tattacttgtcactgttg

SEQ ID NO: 67726 - DNA, 18 bp, synthetic construct
  source 1..18: mol_type = other DNA
tattaggattcaattttg

SEQ ID NO: 67727 - DNA, 18 bp, synthetic construct
  source 1..18: mol_type = other DNA
tattaggtgtcacaatag

SEQ ID NO: 67728 - DNA, 18 bp, synthetic construct
  source 1..18: mol_type = other DNA
tattagtttacacgatag

SEQ ID NO: 67729 - DNA, 18 bp, synthetic construct
  source 1..18: mol_type = other DNA
tattatgaatctctattg

SEQ ID NO: 67730 - DNA, 18 bp, synthetic construct
  source 1..18: mol_type = other DNA
tattatgacaatctttag

SEQ ID NO: 67731 - DNA, 18 bp, synthetic construct
  source 1..18: mol_type = other DNA
tattatgactctctgaag

SEQ ID NO: 67732 - DNA, 18 bp, synthetic construct
  source 1..18: mol_type = other DNA
tattatgactctctttcg

SEQ ID NO: 67733 - DNA, 18 bp, synthetic construct
  source 1..18: mol_type = other DNA
tattatgcaacaatatag

SEQ ID NO: 67734 - DNA, 18 bp, synthetic construct
  source 1..18: mol_type = other DNA
tattatgtaacactaatg

SEQ ID NO: 67735 - DNA, 18 bp, synthetic construct
  source 1..18: mol_type = other DNA
tattatgtctaattatag

SEQ ID NO: 67736 - DNA, 18 bp, synthetic construct
  source 1..18: mol_type = other DNA
tattatgtctcacagtag

SEQ ID NO: 67737 - DNA, 18 bp, synthetic construct
  source 1..18: mol_type = other DNA
tattattactcacaatgg

SEQ ID NO: 67738 - DNA, 18 bp, synthetic construct
  source 1..18: mol_type = other DNA
tattatttctttctattg

SEQ ID NO: 67739 - DNA, 18 bp, synthetic construct
  source 1..18: mol_type = other DNA
tattcaggttaacccttg

SEQ ID NO: 67740 - DNA, 18 bp, synthetic construct
  source 1..18: mol_type = other DNA
tattccctctctctttag

SEQ ID NO: 67741 - DNA, 18 bp, synthetic construct
  source 1..18: mol_type = other DNA
tattccgacactctttag

SEQ ID NO: 67742 - DNA, 18 bp, synthetic construct
  source 1..18: mol_type = other DNA
tattccgacattcaatag

SEQ ID NO: 67743 - DNA, 18 bp, synthetic construct
  source 1..18: mol_type = other DNA
tattccgagtcaatacag

SEQ ID NO: 67744 - DNA, 18 bp, synthetic construct
  source 1..18: mol_type = other DNA
tattccgattcactgttg

SEQ ID NO: 67745 - DNA, 18 bp, synthetic construct
  source 1..18: mol_type = other DNA
tattccgatttacttgag

SEQ ID NO: 67746 - DNA, 18 bp, synthetic construct
  source 1..18: mol_type = other DNA
tattcctactctctttag

SEQ ID NO: 67747 - DNA, 18 bp, synthetic construct
  source 1..18: mol_type = other DNA
tattctaaatcacttgag

SEQ ID NO: 67748 - DNA, 18 bp, synthetic construct
  source 1..18: mol_type = other DNA
tattgcgactatcatttg

SEQ ID NO: 67749 - DNA, 18 bp, synthetic construct
  source 1..18: mol_type = other DNA
tattgcgacttacttttg

SEQ ID NO: 67750 - DNA, 18 bp, synthetic construct
  source 1..18: mol_type = other DNA
tattgtgactcattctag

SEQ ID NO: 67751 - DNA, 18 bp, synthetic construct
  source 1..18: mol_type = other DNA
tatttagtctcactctag

SEQ ID NO: 67752 - DNA, 18 bp, synthetic construct
  source 1..18: mol_type = other DNA
tatttagtctcactgtag

SEQ ID NO: 67753 - DNA, 18 bp, synthetic construct
  source 1..18: mol_type = other DNA
tatttcaacaccctttag

SEQ ID NO: 67754 - DNA, 18 bp, synthetic construct
  source 1..18: mol_type = other DNA
tatttcaactcacaaatg

SEQ ID NO: 67755 - DNA, 18 bp, synthetic construct
  source 1..18: mol_type = other DNA
tatttcatctcactattg

SEQ ID NO: 67756 - DNA, 18 bp, synthetic construct
  source 1..18: mol_type = other DNA
tatttccactcaatattg

SEQ ID NO: 67757 - DNA, 18 bp, synthetic construct
  source 1..18: mol_type = other DNA
tatttccattaactgaag

SEQ ID NO: 67758 - DNA, 18 bp, synthetic construct
  source 1..18: mol_type = other DNA
tatttcccctcactaaag

SEQ ID NO: 67759 - DNA, 18 bp, synthetic construct
  source 1..18: mol_type = other DNA
tatttcgaatcacattag

SEQ ID NO: 67760 - DNA, 18 bp, synthetic construct
  source 1..18: mol_type = other DNA
tatttcgaatctctaaag

SEQ ID NO: 67761 - DNA, 18 bp, synthetic construct
  source 1..18: mol_type = other DNA
tatttcgacttattatgg

SEQ ID NO: 67762 - DNA, 18 bp, synthetic construct
  source 1..18: mol_type = other DNA
tatttcgatacacaatag

SEQ ID NO: 67763 - DNA, 18 bp, synthetic construct
  source 1..18: mol_type = other DNA
tatttcgatactccttag

SEQ ID NO: 67764 - DNA, 18 bp, synthetic construct
  source 1..18: mol_type = other DNA
tatttcgtatccctatag

SEQ ID NO: 67765 - DNA, 18 bp, synthetic construct
  source 1..18: mol_type = other DNA
tatttcgtctcacctttg

SEQ ID NO: 67766 - DNA, 18 bp, synthetic construct
  source 1..18: mol_type = other DNA
tatttcgtgttactatag

SEQ ID NO: 67767 - DNA, 18 bp, synthetic construct
  source 1..18: mol_type = other DNA
tatttcgttccactgtag

SEQ ID NO: 67768 - DNA, 18 bp, synthetic construct
  source 1..18: mol_type = other DNA
tatttcttcgctatattg

SEQ ID NO: 67769 - DNA, 18 bp, synthetic construct
  source 1..18: mol_type = other DNA
tatttgctctcactatag

SEQ ID NO: 67770 - DNA, 18 bp, synthetic construct
  source 1..18: mol_type = other DNA
tatttgtactcactatgg

SEQ ID NO: 67771 - DNA, 18 bp, synthetic construct
  source 1..18: mol_type = other DNA
tattttcactcacttaag

SEQ ID NO: 67772 - DNA, 18 bp, synthetic construct
  source 1..18: mol_type = other DNA
tattttcgcacactctag

SEQ ID NO: 67773 - DNA, 18 bp, synthetic construct
  source 1..18: mol_type = other DNA
tattttgactctggatag

SEQ ID NO: 67774 - DNA, 18 bp, synthetic construct
  source 1..18: mol_type = other DNA
tattttgagccattgaag

SEQ ID NO: 67775 - DNA, 18 bp, synthetic construct
  source 1..18: mol_type = other DNA
tcaaacaacacgatatag

SEQ ID NO: 67776 - DNA, 18 bp, synthetic construct
  source 1..18: mol_type = other DNA
tcaaacgacactatatag

SEQ ID NO: 67777 - DNA, 18 bp, synthetic construct
  source 1..18: mol_type = other DNA
tcaaacgactcacaactg

SEQ ID NO: 67778 - DNA, 18 bp, synthetic construct
  source 1..18: mol_type = other DNA
tcaaacgacttttcaaag

SEQ ID NO: 67779 - DNA, 18 bp, synthetic construct
  source 1..18: mol_type = other DNA
tcaaacgtgtcacaatcg

SEQ ID NO: 67780 - DNA, 18 bp, synthetic construct
  source 1..18: mol_type = other DNA
tcaagggatacactatag

SEQ ID NO: 67781 - DNA, 18 bp, synthetic construct
  source 1..18: mol_type = other DNA
tcacacgactcattttcg

SEQ ID NO: 67782 - DNA, 18 bp, synthetic construct
  source 1..18: mol_type = other DNA
tcacacgattcaacgcag

SEQ ID NO: 67783 - DNA, 18 bp, synthetic construct
  source 1..18: mol_type = other DNA
tcacacgtccatcaatag

SEQ ID NO: 67784 - DNA, 18 bp, synthetic construct
  source 1..18: mol_type = other DNA
tcacgtcactctctatag

SEQ ID NO: 67785 - DNA, 18 bp, synthetic construct
  source 1..18: mol_type = other DNA
tcactagacagattctgg

SEQ ID NO: 67786 - DNA, 18 bp, synthetic construct
  source 1..18: mol_type = other DNA
tcagacgacacagtacag

SEQ ID NO: 67787 - DNA, 18 bp, synthetic construct
  source 1..18: mol_type = other DNA
tcagacgcctgactagtg

SEQ ID NO: 67788 - DNA, 18 bp, synthetic construct
  source 1..18: mol_type = other DNA
tcataacgctcactaaag

SEQ ID NO: 67789 - DNA, 18 bp, synthetic construct
  source 1..18: mol_type = other DNA
tcatacaagtatccatag

SEQ ID NO: 67790 - DNA, 18 bp, synthetic construct
  source 1..18: mol_type = other DNA
tcatacaattcgatatag

SEQ ID NO: 67791 - DNA, 18 bp, synthetic construct
  source 1..18: mol_type = other DNA
tcatacatctcattatgg

SEQ ID NO: 67792 - DNA, 18 bp, synthetic construct
  source 1..18: mol_type = other DNA
tcatacatctctctaacg

SEQ ID NO: 67793 - DNA, 18 bp, synthetic construct
  source 1..18: mol_type = other DNA
tcatacctcactctctag

SEQ ID NO: 67794 - DNA, 18 bp, synthetic construct
  source 1..18: mol_type = other DNA
tcatacgaatcacctagg

SEQ ID NO: 67795 - DNA, 18 bp, synthetic construct
  source 1..18: mol_type = other DNA
tcatacgacactctcatg

SEQ ID NO: 67796 - DNA, 18 bp, synthetic construct
  source 1..18: mol_type = other DNA
tcatacgacgcactgacg

SEQ ID NO: 67797 - DNA, 18 bp, synthetic construct
  source 1..18: mol_type = other DNA
tcatacgactattacaag

SEQ ID NO: 67798 - DNA, 18 bp, synthetic construct
  source 1..18: mol_type = other DNA
tcatacgacttaattttg

SEQ ID NO: 67799 - DNA, 18 bp, synthetic construct
  source 1..18: mol_type = other DNA
tcatacgacttattcttg

SEQ ID NO: 67800 - DNA, 18 bp, synthetic construct
  source 1..18: mol_type = other DNA
tcatacgatccacactag

SEQ ID NO: 67801 - DNA, 18 bp, synthetic construct
  source 1..18: mol_type = other DNA
tcatacgatttgttctcg

SEQ ID NO: 67802 - DNA, 18 bp, synthetic construct
  source 1..18: mol_type = other DNA
tcatacgccccaaaatag

SEQ ID NO: 67803 - DNA, 18 bp, synthetic construct
  source 1..18: mol_type = other DNA
tcatacgcctcgacatag

SEQ ID NO: 67804 - DNA, 18 bp, synthetic construct
  source 1..18: mol_type = other DNA
tcatacggcacccgatag

SEQ ID NO: 67805 - DNA, 18 bp, synthetic construct
  source 1..18: mol_type = other DNA
tcatacggcccgctgtag

SEQ ID NO: 67806 - DNA, 18 bp, synthetic construct
  source 1..18: mol_type = other DNA
tcatacggctatctattg

SEQ ID NO: 67807 - DNA, 18 bp, synthetic construct
  source 1..18: mol_type = other DNA
tcatacggtcaactatag

SEQ ID NO: 67808 - DNA, 18 bp, synthetic construct
  source 1..18: mol_type = other DNA
tcatacgtatcacttaag

SEQ ID NO: 67809 - DNA, 18 bp, synthetic construct
  source 1..18: mol_type = other DNA
tcatacgtcatactatcg

SEQ ID NO: 67810 - DNA, 18 bp, synthetic construct
  source 1..18: mol_type = other DNA
tcatacgtccctctttag

SEQ ID NO: 67811 - DNA, 18 bp, synthetic construct
  source 1..18: mol_type = other DNA
tcatacgtttctgtatag

SEQ ID NO: 67812 - DNA, 18 bp, synthetic construct
  source 1..18: mol_type = other DNA
tcatactcctaattaaag

SEQ ID NO: 67813 - DNA, 18 bp, synthetic construct
  source 1..18: mol_type = other DNA
tcatacttatcactattg

SEQ ID NO: 67814 - DNA, 18 bp, synthetic construct
  source 1..18: mol_type = other DNA
tcatacttttcactatgg

SEQ ID NO: 67815 - DNA, 18 bp, synthetic construct
  source 1..18: mol_type = other DNA
tcataggaattccaacag

SEQ ID NO: 67816 - DNA, 18 bp, synthetic construct
  source 1..18: mol_type = other DNA
tcatatgacatattaaag

SEQ ID NO: 67817 - DNA, 18 bp, synthetic construct
  source 1..18: mol_type = other DNA
tcatatgtctcccttcag

SEQ ID NO: 67818 - DNA, 18 bp, synthetic construct
  source 1..18: mol_type = other DNA
tcatattcgtctctaacg

SEQ ID NO: 67819 - DNA, 18 bp, synthetic construct
  source 1..18: mol_type = other DNA
tcatccgattctctattg

SEQ ID NO: 67820 - DNA, 18 bp, synthetic construct
  source 1..18: mol_type = other DNA
tcatgcgttacttcgtag

SEQ ID NO: 67821 - DNA, 18 bp, synthetic construct
  source 1..18: mol_type = other DNA
tcattagacatagtaaag

SEQ ID NO: 67822 - DNA, 18 bp, synthetic construct
  source 1..18: mol_type = other DNA
tcattagcctcactctag

SEQ ID NO: 67823 - DNA, 18 bp, synthetic construct
  source 1..18: mol_type = other DNA
tcattccatacacttttg

SEQ ID NO: 67824 - DNA, 18 bp, synthetic construct
  source 1..18: mol_type = other DNA
tcattcgattctatatag

SEQ ID NO: 67825 - DNA, 18 bp, synthetic construct
  source 1..18: mol_type = other DNA
tcattcgtttcaaactag

SEQ ID NO: 67826 - DNA, 18 bp, synthetic construct
  source 1..18: mol_type = other DNA
tccaacatctcactatag

SEQ ID NO: 67827 - DNA, 18 bp, synthetic construct
  source 1..18: mol_type = other DNA
tccattgattcactattg

SEQ ID NO: 67828 - DNA, 18 bp, synthetic construct
  source 1..18: mol_type = other DNA
tcctatgccacaatttag

SEQ ID NO: 67829 - DNA, 18 bp, synthetic construct
  source 1..18: mol_type = other DNA
tcgaacaggacactaaag

SEQ ID NO: 67830 - DNA, 18 bp, synthetic construct
  source 1..18: mol_type = other DNA
tcgaacgacacaccattg

SEQ ID NO: 67831 - DNA, 18 bp, synthetic construct
  source 1..18: mol_type = other DNA
tcgaacgactcacttcag

SEQ ID NO: 67832 - DNA, 18 bp, synthetic construct
  source 1..18: mol_type = other DNA
tcgtactacttaatatag

SEQ ID NO: 67833 - DNA, 18 bp, synthetic construct
  source 1..18: mol_type = other DNA
tcgtatgactcaatgtcg

SEQ ID NO: 67834 - DNA, 18 bp, synthetic construct
  source 1..18: mol_type = other DNA
tctaaccactcaatatag

SEQ ID NO: 67835 - DNA, 18 bp, synthetic construct
  source 1..18: mol_type = other DNA
tctaacgcttaactacag

SEQ ID NO: 67836 - DNA, 18 bp, synthetic construct
  source 1..18: mol_type = other DNA
tctcatgattcactctag

SEQ ID NO: 67837 - DNA, 18 bp, synthetic construct
  source 1..18: mol_type = other DNA
tcttaagatacactatag

SEQ ID NO: 67838 - DNA, 18 bp, synthetic construct
  source 1..18: mol_type = other DNA
tcttaccacttactaaag

SEQ ID NO: 67839 - DNA, 18 bp, synthetic construct
  source 1..18: mol_type = other DNA
tcttacgaaacacattag

SEQ ID NO: 67840 - DNA, 18 bp, synthetic construct
  source 1..18: mol_type = other DNA
tcttacgacttattatcg

SEQ ID NO: 67841 - DNA, 18 bp, synthetic construct
  source 1..18: mol_type = other DNA
tcttacgcctctcaattg

SEQ ID NO: 67842 - DNA, 18 bp, synthetic construct
  source 1..18: mol_type = other DNA
tcttacttcacactatag

SEQ ID NO: 67843 - DNA, 18 bp, synthetic construct
  source 1..18: mol_type = other DNA
tgaaacaatttccgttag

SEQ ID NO: 67844 - DNA, 18 bp, synthetic construct
  source 1..18: mol_type = other DNA
tgaaacgactcataaaag

SEQ ID NO: 67845 - DNA, 18 bp, synthetic construct
  source 1..18: mol_type = other DNA
tgaaacgatttgctggag

SEQ ID NO: 67846 - DNA, 18 bp, synthetic construct
  source 1..18: mol_type = other DNA
tgaatctacccactatag

SEQ ID NO: 67847 - DNA, 18 bp, synthetic construct
  source 1..18: mol_type = other DNA
tgacacagctctctactg

SEQ ID NO: 67848 - DNA, 18 bp, synthetic construct
  source 1..18: mol_type = other DNA
tgacacatctcacataag

SEQ ID NO: 67849 - DNA, 18 bp, synthetic construct
  source 1..18: mol_type = other DNA
tgacactactctctagag

SEQ ID NO: 67850 - DNA, 18 bp, synthetic construct
  source 1..18: mol_type = other DNA
tgacgcgcctcactattg

SEQ ID NO: 67851 - DNA, 18 bp, synthetic construct
  source 1..18: mol_type = other DNA
tgataacattcacattag

SEQ ID NO: 67852 - DNA, 18 bp, synthetic construct
  source 1..18: mol_type = other DNA
tgataagactcataatgg

SEQ ID NO: 67853 - DNA, 18 bp, synthetic construct
  source 1..18: mol_type = other DNA
tgataagacttaatagag

SEQ ID NO: 67854 - DNA, 18 bp, synthetic construct
  source 1..18: mol_type = other DNA
tgataatactcgttatag

SEQ ID NO: 67855 - DNA, 18 bp, synthetic construct
  source 1..18: mol_type = other DNA
tgatacaacacacaaaag

SEQ ID NO: 67856 - DNA, 18 bp, synthetic construct
  source 1..18: mol_type = other DNA
tgatacaactttctattg

SEQ ID NO: 67857 - DNA, 18 bp, synthetic construct
  source 1..18: mol_type = other DNA
tgatacatctaactatcg

SEQ ID NO: 67858 - DNA, 18 bp, synthetic construct
  source 1..18: mol_type = other DNA
tgatacgagttatgttag

SEQ ID NO: 67859 - DNA, 18 bp, synthetic construct
  source 1..18: mol_type = other DNA
tgatacgattctctaatg

SEQ ID NO: 67860 - DNA, 18 bp, synthetic construct
  source 1..18: mol_type = other DNA
tgatacgccacgctattg

SEQ ID NO: 67861 - DNA, 18 bp, synthetic construct
  source 1..18: mol_type = other DNA
tgatacgtcacacaatgg

SEQ ID NO: 67862 - DNA, 18 bp, synthetic construct
  source 1..18: mol_type = other DNA
tgatacgtcttactgaag

SEQ ID NO: 67863 - DNA, 18 bp, synthetic construct
  source 1..18: mol_type = other DNA
tgatacgtttcaccctag

SEQ ID NO: 67864 - DNA, 18 bp, synthetic construct
  source 1..18: mol_type = other DNA
tgatactacttaatatcg

SEQ ID NO: 67865 - DNA, 18 bp, synthetic construct
  source 1..18: mol_type = other DNA
tgatactacttgttataa

SEQ ID NO: 67866 - DNA, 18 bp, synthetic construct
  source 1..18: mol_type = other DNA
tgatactagtcactaatg

SEQ ID NO: 67867 - DNA, 18 bp, synthetic construct
  source 1..18: mol_type = other DNA
tgatacttccaaatatag

SEQ ID NO: 67868 - DNA, 18 bp, synthetic construct
  source 1..18: mol_type = other DNA
tgatacttctcacaattg

SEQ ID NO: 67869 - DNA, 18 bp, synthetic construct
  source 1..18: mol_type = other DNA
tgatatgacttactgtgg

SEQ ID NO: 67870 - DNA, 18 bp, synthetic construct
  source 1..18: mol_type = other DNA
tgatctgactccctttag

SEQ ID NO: 67871 - DNA, 18 bp, synthetic construct
  source 1..18: mol_type = other DNA
tgatgagatccattatag

SEQ ID NO: 67872 - DNA, 18 bp, synthetic construct
  source 1..18: mol_type = other DNA
tgatgccacacccttttg

SEQ ID NO: 67873 - DNA, 18 bp, synthetic construct
  source 1..18: mol_type = other DNA
tgattagactccatagag

SEQ ID NO: 67874 - DNA, 18 bp, synthetic construct
  source 1..18: mol_type = other DNA
tgattcaactcattcttg

SEQ ID NO: 67875 - DNA, 18 bp, synthetic construct
  source 1..18: mol_type = other DNA
tgattcaattcacgttag

SEQ ID NO: 67876 - DNA, 18 bp, synthetic construct
  source 1..18: mol_type = other DNA
tgattcgactcacgtttg

SEQ ID NO: 67877 - DNA, 18 bp, synthetic construct
  source 1..18: mol_type = other DNA
tgattcgactctctgtcg

SEQ ID NO: 67878 - DNA, 18 bp, synthetic construct
  source 1..18: mol_type = other DNA
tgattgatctcactttag

SEQ ID NO: 67879 - DNA, 18 bp, synthetic construct
  source 1..18: mol_type = other DNA
tgattggtctacctgtag

SEQ ID NO: 67880 - DNA, 18 bp, synthetic construct
  source 1..18: mol_type = other DNA
tgcctcgactctatatgg

SEQ ID NO: 67881 - DNA, 18 bp, synthetic construct
  source 1..18: mol_type = other DNA
tgctactactcaattttg

SEQ ID NO: 67882 - DNA, 18 bp, synthetic construct
  source 1..18: mol_type = other DNA
tgcttcttttcactatgg

SEQ ID NO: 67883 - DNA, 18 bp, synthetic construct
  source 1..18: mol_type = other DNA
tggctctattctctattg

SEQ ID NO: 67884 - DNA, 18 bp, synthetic construct
  source 1..18: mol_type = other DNA
tggtacgactctcaattg

SEQ ID NO: 67885 - DNA, 18 bp, synthetic construct
  source 1..18: mol_type = other DNA
tggtacgatacaacatag

SEQ ID NO: 67886 - DNA, 18 bp, synthetic construct
  source 1..18: mol_type = other DNA
tggtacgtttcattaaag

SEQ ID NO: 67887 - DNA, 18 bp, synthetic construct
  source 1..18: mol_type = other DNA
tgtaaccactgacaattg

SEQ ID NO: 67888 - DNA, 18 bp, synthetic construct
  source 1..18: mol_type = other DNA
tgtaacgacttactattg

SEQ ID NO: 67889 - DNA, 18 bp, synthetic construct
  source 1..18: mol_type = other DNA
tgtagcgactcttttaag

SEQ ID NO: 67890 - DNA, 18 bp, synthetic construct
  source 1..18: mol_type = other DNA
tgtcacgactcaatactg

SEQ ID NO: 67891 - DNA, 18 bp, synthetic construct
  source 1..18: mol_type = other DNA
tgtcatgattcactattg

SEQ ID NO: 67892 - DNA, 18 bp, synthetic construct
  source 1..18: mol_type = other DNA
tgttacaagacactgtcg

SEQ ID NO: 67893 - DNA, 18 bp, synthetic construct
  source 1..18: mol_type = other DNA
tgttaccattcgctatag

SEQ ID NO: 67894 - DNA, 18 bp, synthetic construct
  source 1..18: mol_type = other DNA
tgttacgacacgcaatag

SEQ ID NO: 67895 - DNA, 18 bp, synthetic construct
  source 1..18: mol_type = other DNA
tgttacgacacgcttaag

SEQ ID NO: 67896 - DNA, 18 bp, synthetic construct
  source 1..18: mol_type = other DNA
tgttacgactttttttag

SEQ ID NO: 67897 - DNA, 18 bp, synthetic construct
  source 1..18: mol_type = other DNA
tgttcagacgcgctgaag

SEQ ID NO: 67898 - DNA, 18 bp, synthetic construct
  source 1..18: mol_type = other DNA
tgtttctactcattaaag

SEQ ID NO: 67899 - DNA, 18 bp, synthetic construct
  source 1..18: mol_type = other DNA
ttaaacgatccactggag

SEQ ID NO: 67900 - DNA, 18 bp, synthetic construct
  source 1..18: mol_type = other DNA
ttaaacgattcattaaag

SEQ ID NO: 67901 - DNA, 18 bp, synthetic construct
  source 1..18: mol_type = other DNA
ttaaacgcatcaccactg

SEQ ID NO: 67902 - DNA, 18 bp, synthetic construct
  source 1..18: mol_type = other DNA
ttaaacgtcactctattg

SEQ ID NO: 67903 - DNA, 18 bp, synthetic construct
  source 1..18: mol_type = other DNA
ttaaacgtcattctatag

SEQ ID NO: 67904 - DNA, 18 bp, synthetic construct
  source 1..18: mol_type = other DNA
ttaaacgtctcaaaatag

SEQ ID NO: 67905 - DNA, 18 bp, synthetic construct
  source 1..18: mol_type = other DNA
ttaaactactcagtaaag

SEQ ID NO: 67906 - DNA, 18 bp, synthetic construct
  source 1..18: mol_type = other DNA
ttaaaggactctctgtag

SEQ ID NO: 67907 - DNA, 18 bp, synthetic construct
  source 1..18: mol_type = other DNA
ttaaatgactcattgtag

SEQ ID NO: 67908 - DNA, 18 bp, synthetic construct
  source 1..18: mol_type = other DNA
ttaaatgagtaactatag

SEQ ID NO: 67909 - DNA, 18 bp, synthetic construct
  source 1..18: mol_type = other DNA
ttaaatgcagttctatag

SEQ ID NO: 67910 - DNA, 18 bp, synthetic construct
  source 1..18: mol_type = other DNA
ttaaattacactcgattg

SEQ ID NO: 67911 - DNA, 18 bp, synthetic construct
  source 1..18: mol_type = other DNA
ttaacagactcactatgg

SEQ ID NO: 67912 - DNA, 18 bp, synthetic construct
  source 1..18: mol_type = other DNA
ttaaccaattcactatag

SEQ ID NO: 67913 - DNA, 18 bp, synthetic construct
  source 1..18: mol_type = other DNA
ttaagcgtccgactgttg

SEQ ID NO: 67914 - DNA, 18 bp, synthetic construct
  source 1..18: mol_type = other DNA
ttaagctattcactaaag

SEQ ID NO: 67915 - DNA, 18 bp, synthetic construct
  source 1..18: mol_type = other DNA
ttaatcgacaccctatag

SEQ ID NO: 67916 - DNA, 18 bp, synthetic construct
  source 1..18: mol_type = other DNA
ttaatcgtcacgctatag

SEQ ID NO: 67917 - DNA, 18 bp, synthetic construct
  source 1..18: mol_type = other DNA
ttaatcgtctagctctag

SEQ ID NO: 67918 - DNA, 18 bp, synthetic construct
  source 1..18: mol_type = other DNA
ttaatcttgtcacaatcg

SEQ ID NO: 67919 - DNA, 18 bp, synthetic construct
  source 1..18: mol_type = other DNA
ttacacaacccacaatag

SEQ ID NO: 67920 - DNA, 18 bp, synthetic construct
  source 1..18: mol_type = other DNA
ttacacgaccaactgtag

SEQ ID NO: 67921 - DNA, 18 bp, synthetic construct
  source 1..18: mol_type = other DNA
ttacacgtgtcattatag

SEQ ID NO: 67922 - DNA, 18 bp, synthetic construct
  source 1..18: mol_type = other DNA
ttacatgaatcactaaag

SEQ ID NO: 67923 - DNA, 18 bp, synthetic construct
  source 1..18: mol_type = other DNA
ttacgcgattcattattg

SEQ ID NO: 67924 - DNA, 18 bp, synthetic construct
  source 1..18: mol_type = other DNA
ttactctactcacaatag

SEQ ID NO: 67925 - DNA, 18 bp, synthetic construct
  source 1..18: mol_type = other DNA
ttacttgagttactattg

SEQ ID NO: 67926 - DNA, 18 bp, synthetic construct
  source 1..18: mol_type = other DNA
ttagacgacgctgtttag

SEQ ID NO: 67927 - DNA, 18 bp, synthetic construct
  source 1..18: mol_type = other DNA
ttagacgattcaagttcg

SEQ ID NO: 67928 - DNA, 18 bp, synthetic construct
  source 1..18: mol_type = other DNA
ttagactattctctttag

SEQ ID NO: 67929 - DNA, 18 bp, synthetic construct
  source 1..18: mol_type = other DNA
ttagccgccacataatag

SEQ ID NO: 67930 - DNA, 18 bp, synthetic construct
  source 1..18: mol_type = other DNA
ttataagacccattgtag

SEQ ID NO: 67931 - DNA, 18 bp, synthetic construct
  source 1..18: mol_type = other DNA
ttataatgcccacttaag

SEQ ID NO: 67932 - DNA, 18 bp, synthetic construct
  source 1..18: mol_type = other DNA
ttatacaactgacatttg

SEQ ID NO: 67933 - DNA, 18 bp, synthetic construct
  source 1..18: mol_type = other DNA
ttatacaacttcataaag

SEQ ID NO: 67934 - DNA, 18 bp, synthetic construct
  source 1..18: mol_type = other DNA
ttatacaactttctattg

SEQ ID NO: 67935 - DNA, 18 bp, synthetic construct
  source 1..18: mol_type = other DNA
ttatacaattcaatattg

SEQ ID NO: 67936 - DNA, 18 bp, synthetic construct
  source 1..18: mol_type = other DNA
ttatacaattcaatttag

SEQ ID NO: 67937 - DNA, 18 bp, synthetic construct
  source 1..18: mol_type = other DNA
ttatacatttccctattg

SEQ ID NO: 67938 - DNA, 18 bp, synthetic construct
  source 1..18: mol_type = other DNA
ttatacatttgattatag

SEQ ID NO: 67939 - DNA, 18 bp, synthetic construct
  source 1..18: mol_type = other DNA
ttatacctcttacaatag

SEQ ID NO: 67940 - DNA, 18 bp, synthetic construct
  source 1..18: mol_type = other DNA
ttatacgaattataatag

SEQ ID NO: 67941 - DNA, 18 bp, synthetic construct
  source 1..18: mol_type = other DNA
ttatacgacccttaatag

SEQ ID NO: 67942 - DNA, 18 bp, synthetic construct
  source 1..18: mol_type = other DNA
ttatacgactcaaaaatg

SEQ ID NO: 67943 - DNA, 18 bp, synthetic construct
  source 1..18: mol_type = other DNA
ttatacgactgaatttcg

SEQ ID NO: 67944 - DNA, 18 bp, synthetic construct
  source 1..18: mol_type = other DNA
ttatacgagcaacgtaag

SEQ ID NO: 67945 - DNA, 18 bp, synthetic construct
  source 1..18: mol_type = other DNA
ttatacgataaactaaag

SEQ ID NO: 67946 - DNA, 18 bp, synthetic construct
  source 1..18: mol_type = other DNA
ttatacgcacctctgtcg

SEQ ID NO: 67947 - DNA, 18 bp, synthetic construct
  source 1..18: mol_type = other DNA
ttatacgccaggttatag

SEQ ID NO: 67948 - DNA, 18 bp, synthetic construct
  source 1..18: mol_type = other DNA
ttatacgcctctccaaag

SEQ ID NO: 67949 - DNA, 18 bp, synthetic construct
  source 1..18: mol_type = other DNA
ttatacgcctctctgaag

SEQ ID NO: 67950 - DNA, 18 bp, synthetic construct
  source 1..18: mol_type = other DNA
ttatacgtatcaccgaag

SEQ ID NO: 67951 - DNA, 18 bp, synthetic construct
  source 1..18: mol_type = other DNA
ttatacgtcacacactcg

SEQ ID NO: 67952 - DNA, 18 bp, synthetic construct
  source 1..18: mol_type = other DNA
ttatacgtcaccctaaag

SEQ ID NO: 67953 - DNA, 18 bp, synthetic construct
  source 1..18: mol_type = other DNA
ttatacgtctctcattag

SEQ ID NO: 67954 - DNA, 18 bp, synthetic construct
  source 1..18: mol_type = other DNA
ttatacgtctgatattag

SEQ ID NO: 67955 - DNA, 18 bp, synthetic construct
  source 1..18: mol_type = other DNA
ttatacgtcttacactag

SEQ ID NO: 67956 - DNA, 18 bp, synthetic construct
  source 1..18: mol_type = other DNA
ttatacgtgacacccttg

SEQ ID NO: 67957 - DNA, 18 bp, synthetic construct
  source 1..18: mol_type = other DNA
ttatacgtgtatcactag

SEQ ID NO: 67958 - DNA, 18 bp, synthetic construct
  source 1..18: mol_type = other DNA
ttatacgttagacgattg

SEQ ID NO: 67959 - DNA, 18 bp, synthetic construct
  source 1..18: mol_type = other DNA
ttatactacactcaatag

SEQ ID NO: 67960 - DNA, 18 bp, synthetic construct
  source 1..18: mol_type = other DNA
ttatactattcacactag

SEQ ID NO: 67961 - DNA, 18 bp, synthetic construct
  source 1..18: mol_type = other DNA
ttatacttctttccatag

SEQ ID NO: 67962 - DNA, 18 bp, synthetic construct
  source 1..18: mol_type = other DNA
ttatagcactcactaacg

SEQ ID NO: 67963 - DNA, 18 bp, synthetic construct
  source 1..18: mol_type = other DNA
ttatagctcccacttaag

SEQ ID NO: 67964 - DNA, 18 bp, synthetic construct
  source 1..18: mol_type = other DNA
ttataggaatgacaattg

SEQ ID NO: 67965 - DNA, 18 bp, synthetic construct
  source 1..18: mol_type = other DNA
ttataggactcaaaaaag

SEQ ID NO: 67966 - DNA, 18 bp, synthetic construct
  source 1..18: mol_type = other DNA
ttataggtaactctaaag

SEQ ID NO: 67967 - DNA, 18 bp, synthetic construct
  source 1..18: mol_type = other DNA
ttataggtctcattacag

SEQ ID NO: 67968 - DNA, 18 bp, synthetic construct
  source 1..18: mol_type = other DNA
ttatataactcacattag

SEQ ID NO: 67969 - DNA, 18 bp, synthetic construct
  source 1..18: mol_type = other DNA
ttatatcactctttcaag

SEQ ID NO: 67970 - DNA, 18 bp, synthetic construct
  source 1..18: mol_type = other DNA
ttatatgacacactaagg

SEQ ID NO: 67971 - DNA, 18 bp, synthetic construct
  source 1..18: mol_type = other DNA
ttatatgacatattattg

SEQ ID NO: 67972 - DNA, 18 bp, synthetic construct
  source 1..18: mol_type = other DNA
ttatatgactctatctag

SEQ ID NO: 67973 - DNA, 18 bp, synthetic construct
  source 1..18: mol_type = other DNA
ttatatgcattacttagg

SEQ ID NO: 67974 - DNA, 18 bp, synthetic construct
  source 1..18: mol_type = other DNA
ttatatggcacaatatag

SEQ ID NO: 67975 - DNA, 18 bp, synthetic construct
  source 1..18: mol_type = other DNA
ttatatgtcacacgaatg

SEQ ID NO: 67976 - DNA, 18 bp, synthetic construct
  source 1..18: mol_type = other DNA
ttatatgtctcacattag

SEQ ID NO: 67977 - DNA, 18 bp, synthetic construct
  source 1..18: mol_type = other DNA
ttatatgtctctctcaag

SEQ ID NO: 67978 - DNA, 18 bp, synthetic construct
  source 1..18: mol_type = other DNA
ttatattactcacaaaag

SEQ ID NO: 67979 - DNA, 18 bp, synthetic construct
  source 1..18: mol_type = other DNA
ttatattactttctacag

SEQ ID NO: 67980 - DNA, 18 bp, synthetic construct
  source 1..18: mol_type = other DNA
ttatcaaaattatgaaag

SEQ ID NO: 67981 - DNA, 18 bp, synthetic construct
  source 1..18: mol_type = other DNA
ttatccgacccacttaag

SEQ ID NO: 67982 - DNA, 18 bp, synthetic construct
  source 1..18: mol_type = other DNA
ttatccgtcccagtacag

SEQ ID NO: 67983 - DNA, 18 bp, synthetic construct
  source 1..18: mol_type = other DNA
ttatcctacacacaattg

SEQ ID NO: 67984 - DNA, 18 bp, synthetic construct
  source 1..18: mol_type = other DNA
ttatccttctcactatgg

SEQ ID NO: 67985 - DNA, 18 bp, synthetic construct
  source 1..18: mol_type = other DNA
ttatccttctctctatag

SEQ ID NO: 67986 - DNA, 18 bp, synthetic construct
  source 1..18: mol_type = other DNA
ttatctgtatcactaatg

SEQ ID NO: 67987 - DNA, 18 bp, synthetic construct
  source 1..18: mol_type = other DNA
ttatgagacaaaaaattg

SEQ ID NO: 67988 - DNA, 18 bp, synthetic construct
  source 1..18: mol_type = other DNA
ttatgagacacactaaag

SEQ ID NO: 67989 - DNA, 18 bp, synthetic construct
  source 1..18: mol_type = other DNA
ttatgagtctcaccatag

SEQ ID NO: 67990 - DNA, 18 bp, synthetic construct
  source 1..18: mol_type = other DNA
ttatgcatcttactatag

SEQ ID NO: 67991 - DNA, 18 bp, synthetic construct
  source 1..18: mol_type = other DNA
ttatgcgactctcaaccg

SEQ ID NO: 67992 - DNA, 18 bp, synthetic construct
  source 1..18: mol_type = other DNA
ttatgcgattatctaaag

SEQ ID NO: 67993 - DNA, 18 bp, synthetic construct
  source 1..18: mol_type = other DNA
ttatgcgtctcacaattg

SEQ ID NO: 67994 - DNA, 18 bp, synthetic construct
  source 1..18: mol_type = other DNA
ttattaaactcacaatag

SEQ ID NO: 67995 - DNA, 18 bp, synthetic construct
  source 1..18: mol_type = other DNA
ttattagacttattatag

SEQ ID NO: 67996 - DNA, 18 bp, synthetic construct
  source 1..18: mol_type = other DNA
ttattatacccacatagg

SEQ ID NO: 67997 - DNA, 18 bp, synthetic construct
  source 1..18: mol_type = other DNA
ttattattctcactctag

SEQ ID NO: 67998 - DNA, 18 bp, synthetic construct
  source 1..18: mol_type = other DNA
ttattcaactcagtctag

SEQ ID NO: 67999 - DNA, 18 bp, synthetic construct
  source 1..18: mol_type = other DNA
ttattcaattcaccatag

SEQ ID NO: 68000 - DNA, 18 bp, synthetic construct
  source 1..18: mol_type = other DNA
ttattccactcagcaaag

SEQ ID NO: 68001 - DNA, 18 bp, synthetic construct
  source 1..18: mol_type = other DNA
ttattcgaatcacttttg

SEQ ID NO: 68002 - DNA, 18 bp, synthetic construct
  source 1..18: mol_type = other DNA
ttattcgaatctctatgg

SEQ ID NO: 68003 - DNA, 18 bp, synthetic construct
  source 1..18: mol_type = other DNA
ttattcgacaaactacag

SEQ ID NO: 68004 - DNA, 18 bp, synthetic construct
  source 1..18: mol_type = other DNA
ttattcgacattacattg

SEQ ID NO: 68005 - DNA, 18 bp, synthetic construct
  source 1..18: mol_type = other DNA
ttattcgactcaataatg

SEQ ID NO: 68006 - DNA, 18 bp, synthetic construct
  source 1..18: mol_type = other DNA
ttattcgagaaacttaag

SEQ ID NO: 68007 - DNA, 18 bp, synthetic construct
  source 1..18: mol_type = other DNA
ttattcgatgcactactg

SEQ ID NO: 68008 - DNA, 18 bp, synthetic construct
  source 1..18: mol_type = other DNA
ttattcgattcacattcg

SEQ ID NO: 68009 - DNA, 18 bp, synthetic construct
  source 1..18: mol_type = other DNA
ttattcgcctctcttgag

SEQ ID NO: 68010 - DNA, 18 bp, synthetic construct
  source 1..18: mol_type = other DNA
ttattcgtccatctttag

SEQ ID NO: 68011 - DNA, 18 bp, synthetic construct
  source 1..18: mol_type = other DNA
ttattcgtttctttattg

SEQ ID NO: 68012 - DNA, 18 bp, synthetic construct
  source 1..18: mol_type = other DNA
ttattctactacctaaag

SEQ ID NO: 68013 - DNA, 18 bp, synthetic construct
  source 1..18: mol_type = other DNA
ttattctactcactaatg

SEQ ID NO: 68014 - DNA, 18 bp, synthetic construct
  source 1..18: mol_type = other DNA
ttattctcgttactatag

SEQ ID NO: 68015 - DNA, 18 bp, synthetic construct
  source 1..18: mol_type = other DNA
ttattcttctaacaatag

SEQ ID NO: 68016 - DNA, 18 bp, synthetic construct
  source 1..18: mol_type = other DNA
ttattcttctcccttttg

SEQ ID NO: 68017 - DNA, 18 bp, synthetic construct
  source 1..18: mol_type = other DNA
ttattgcactaactacag

SEQ ID NO: 68018 - DNA, 18 bp, synthetic construct
  source 1..18: mol_type = other DNA
ttattggtattactatag

SEQ ID NO: 68019 - DNA, 18 bp, synthetic construct
  source 1..18: mol_type = other DNA
ttatttgtcacactatag

SEQ ID NO: 68020 - DNA, 18 bp, synthetic construct
  source 1..18: mol_type = other DNA
ttcagcgtctcaatttag

SEQ ID NO: 68021 - DNA, 18 bp, synthetic construct
  source 1..18: mol_type = other DNA
ttccctaattcacaattg

SEQ ID NO: 68022 - DNA, 18 bp, synthetic construct
  source 1..18: mol_type = other DNA
ttcctcgacacaatatag

SEQ ID NO: 68023 - DNA, 18 bp, synthetic construct
  source 1..18: mol_type = other DNA
ttcctcgattcaatatcg

SEQ ID NO: 68024 - DNA, 18 bp, synthetic construct
  source 1..18: mol_type = other DNA
ttctaagacacactattg

SEQ ID NO: 68025 - DNA, 18 bp, synthetic construct
  source 1..18: mol_type = other DNA
ttctacatctcactttag

SEQ ID NO: 68026 - DNA, 18 bp, synthetic construct
  source 1..18: mol_type = other DNA
ttctacgactgtcaatag

SEQ ID NO: 68027 - DNA, 18 bp, synthetic construct
  source 1..18: mol_type = other DNA
ttctacgattgcttaaag

SEQ ID NO: 68028 - DNA, 18 bp, synthetic construct
  source 1..18: mol_type = other DNA
ttctacgtctctcaattg

SEQ ID NO: 68029 - DNA, 18 bp, synthetic construct
  source 1..18: mol_type = other DNA
ttctaggattcactttag

SEQ ID NO: 68030 - DNA, 18 bp, synthetic construct
  source 1..18: mol_type = other DNA
ttctttgtatctctatag

SEQ ID NO: 68031 - DNA, 18 bp, synthetic construct
  source 1..18: mol_type = other DNA
ttgaaagtctcagtattg

SEQ ID NO: 68032 - DNA, 18 bp, synthetic construct
  source 1..18: mol_type = other DNA
ttgaaccactccctatag

SEQ ID NO: 68033 - DNA, 18 bp, synthetic construct
  source 1..18: mol_type = other DNA
ttgcacggattactttcg

SEQ ID NO: 68034 - DNA, 18 bp, synthetic construct
  source 1..18: mol_type = other DNA
ttgctcgactcacaaaag

SEQ ID NO: 68035 - DNA, 18 bp, synthetic construct
  source 1..18: mol_type = other DNA
ttgcttgacatattatag

SEQ ID NO: 68036 - DNA, 18 bp, synthetic construct
  source 1..18: mol_type = other DNA
ttgtacgaaacacaaaag

SEQ ID NO: 68037 - DNA, 18 bp, synthetic construct
  source 1..18: mol_type = other DNA
ttgtacgaatccctattg

SEQ ID NO: 68038 - DNA, 18 bp, synthetic construct
  source 1..18: mol_type = other DNA
ttgtacgattaacaatag

SEQ ID NO: 68039 - DNA, 18 bp, synthetic construct
  source 1..18: mol_type = other DNA
ttgtacggctcagcgtag

SEQ ID NO: 68040 - DNA, 18 bp, synthetic construct
  source 1..18: mol_type = other DNA
ttgtacgtcacactgtag

SEQ ID NO: 68041 - DNA, 18 bp, synthetic construct
  source 1..18: mol_type = other DNA
ttgtacgtctcacatacg

SEQ ID NO: 68042 - DNA, 18 bp, synthetic construct
  source 1..18: mol_type = other DNA
ttgtacgtctcactgttg

SEQ ID NO: 68043 - DNA, 18 bp, synthetic construct
  source 1..18: mol_type = other DNA
ttgtactactcaccattg

SEQ ID NO: 68044 - DNA, 18 bp, synthetic construct
  source 1..18: mol_type = other DNA
ttgtctgataaactaaag

SEQ ID NO: 68045 - DNA, 18 bp, synthetic construct
  source 1..18: mol_type = other DNA
ttgtgcaactgacgattg

SEQ ID NO: 68046 - DNA, 18 bp, synthetic construct
  source 1..18: mol_type = other DNA
ttgttagatatcttatag

SEQ ID NO: 68047 - DNA, 18 bp, synthetic construct
  source 1..18: mol_type = other DNA
ttgttctattcacaattg

SEQ ID NO: 68048 - DNA, 18 bp, synthetic construct
  source 1..18: mol_type = other DNA
tttaaatacaaaataaag

SEQ ID NO: 68049 - DNA, 18 bp, synthetic construct
  source 1..18: mol_type = other DNA
tttaacaactaactatag

SEQ ID NO: 68050 - DNA, 18 bp, synthetic construct
  source 1..18: mol_type = other DNA
tttaacacctcactatag

SEQ ID NO: 68051 - DNA, 18 bp, synthetic construct
  source 1..18: mol_type = other DNA
tttaaccacttactatag

SEQ ID NO: 68052 - DNA, 18 bp, synthetic construct
  source 1..18: mol_type = other DNA
tttaacgactctttgtag

SEQ ID NO: 68053 - DNA, 18 bp, synthetic construct
  source 1..18: mol_type = other DNA
tttaacgatttactatag

SEQ ID NO: 68054 - DNA, 18 bp, synthetic construct
  source 1..18: mol_type = other DNA
tttaacgccccaccacag

SEQ ID NO: 68055 - DNA, 18 bp, synthetic construct
  source 1..18: mol_type = other DNA
tttaactactatatatag

SEQ ID NO: 68056 - DNA, 18 bp, synthetic construct
  source 1..18: mol_type = other DNA
tttaatgacacactatag

SEQ ID NO: 68057 - DNA, 18 bp, synthetic construct
  source 1..18: mol_type = other DNA
tttaatgagtagctatag

SEQ ID NO: 68058 - DNA, 18 bp, synthetic construct
  source 1..18: mol_type = other DNA
tttaatgtcacactaaag

SEQ ID NO: 68059 - DNA, 18 bp, synthetic construct
  source 1..18: mol_type = other DNA
tttagcaactcactctag

SEQ ID NO: 68060 - DNA, 18 bp, synthetic construct
  source 1..18: mol_type = other DNA
tttatcgactcacattgg

SEQ ID NO: 68061 - DNA, 18 bp, synthetic construct
  source 1..18: mol_type = other DNA
tttatcgtctcaatattg

SEQ ID NO: 68062 - DNA, 18 bp, synthetic construct
  source 1..18: mol_type = other DNA
tttcacgactccctaaag

SEQ ID NO: 68063 - DNA, 18 bp, synthetic construct
  source 1..18: mol_type = other DNA
tttcacgtctcaatgaag

SEQ ID NO: 68064 - DNA, 18 bp, synthetic construct
  source 1..18: mol_type = other DNA
tttcccgacttactttag

SEQ ID NO: 68065 - DNA, 18 bp, synthetic construct
  source 1..18: mol_type = other DNA
tttgatgactctctatag

SEQ ID NO: 68066 - DNA, 18 bp, synthetic construct
  source 1..18: mol_type = other DNA
ttttaacactcacaaaag

SEQ ID NO: 68067 - DNA, 18 bp, synthetic construct
  source 1..18: mol_type = other DNA
ttttaatactgcttatag

SEQ ID NO: 68068 - DNA, 18 bp, synthetic construct
  source 1..18: mol_type = other DNA
ttttacaacacattatag

SEQ ID NO: 68069 - DNA, 18 bp, synthetic construct
  source 1..18: mol_type = other DNA
ttttacaactatcaatag

SEQ ID NO: 68070 - DNA, 18 bp, synthetic construct
  source 1..18: mol_type = other DNA
ttttaccactcaactaag

SEQ ID NO: 68071 - DNA, 18 bp, synthetic construct
  source 1..18: mol_type = other DNA
ttttacgaatcattaaag

SEQ ID NO: 68072 - DNA, 18 bp, synthetic construct
  source 1..18: mol_type = other DNA
ttttacgacaatttatag

SEQ ID NO: 68073 - DNA, 18 bp, synthetic construct
  source 1..18: mol_type = other DNA
ttttacgactatctacag

SEQ ID NO: 68074 - DNA, 18 bp, synthetic construct
  source 1..18: mol_type = other DNA
ttttacgactcattcttg

SEQ ID NO: 68075 - DNA, 18 bp, synthetic construct
  source 1..18: mol_type = other DNA
ttttacgagtcaatatgg

SEQ ID NO: 68076 - DNA, 18 bp, synthetic construct
  source 1..18: mol_type = other DNA
ttttacgatgaaccctag

SEQ ID NO: 68077 - DNA, 18 bp, synthetic construct
  source 1..18: mol_type = other DNA
ttttactactgtataaag

SEQ ID NO: 68078 - DNA, 18 bp, synthetic construct
  source 1..18: mol_type = other DNA
ttttagtttactcaatag

SEQ ID NO: 68079 - DNA, 18 bp, synthetic construct
  source 1..18: mol_type = other DNA
ttttatgactcacttgag

SEQ ID NO: 68080 - DNA, 18 bp, synthetic construct
  source 1..18: mol_type = other DNA
ttttgagactgattattg

SEQ ID NO: 68081 - DNA, 18 bp, synthetic construct
  source 1..18: mol_type = other DNA
ttttgcaactatccattg

SEQ ID NO: 68082 - DNA, 18 bp, synthetic construct
  source 1..18: mol_type = other DNA
tttttcgactgactgtag

SEQ ID NO: 68083 - DNA, 18 bp, synthetic construct
  source 1..18: mol_type = other DNA
tttttctactctccatag

SEQ ID NO: 68084 - DNA, 18 bp, synthetic construct
  source 1..18: mol_type = other DNA
ttttttgactcactattg

SEQ ID NO: 68085 - DNA, 18 bp, synthetic construct
  source 1..18: mol_type = other DNA
aaatgggattcacttttg

SEQ ID NO: 68086 - DNA, 18 bp, synthetic construct
  source 1..18: mol_type = other DNA
atatacgtctcacaattg

SEQ ID NO: 68087 - DNA, 18 bp, synthetic construct
  source 1..18: mol_type = other DNA
taataagtcacacaattg

SEQ ID NO: 68088 - DNA, 18 bp, synthetic construct
  source 1..18: mol_type = other DNA
taatacgactctatgatg

SEQ ID NO: 68089 - DNA, 18 bp, synthetic construct
  source 1..18: mol_type = other DNA
taatatggcactctattg

SEQ ID NO: 68090 - DNA, 18 bp, synthetic construct
  source 1..18: mol_type = other DNA
taatgagtctcacttcag

SEQ ID NO: 68091 - DNA, 18 bp, synthetic construct
  source 1..18: mol_type = other DNA
tattacgactgattaatg

SEQ ID NO: 68092 - DNA, 18 bp, synthetic construct
  source 1..18: mol_type = other DNA
tattacgatacactgaag

SEQ ID NO: 68093 - DNA, 18 bp, synthetic construct
  source 1..18: mol_type = other DNA
tcatacaaccagctttag

SEQ ID NO: 68094 - DNA, 18 bp, synthetic construct
  source 1..18: mol_type = other DNA
tgaaacgatttactattg

SEQ ID NO: 68095 - DNA, 18 bp, synthetic construct
  source 1..18: mol_type = other DNA
tgtagcaacacaattcag

SEQ ID NO: 68096 - DNA, 18 bp, synthetic construct
  source 1..18: mol_type = other DNA
ttataagagtctcaatag

SEQ ID NO: 68097 - DNA, 18 bp, synthetic construct
  source 1..18: mol_type = other DNA
ttatacgactaacttatg

SEQ ID NO: 68098 - DNA, 18 bp, synthetic construct
  source 1..18: mol_type = other DNA
ttattcgactcacattcg

SEQ ID NO: 68099 - DNA, 18 bp, synthetic construct
  source 1..18: mol_type = other DNA
ttgtacgactctcttaag

SEQ ID NO: 68100 - DNA, 18 bp, synthetic construct
  source 1..18: mol_type = other DNA
ttgttagacacactttag

SEQ ID NO: 68101 - DNA, 18 bp, synthetic construct
  source 1..18: mol_type = other DNA
atttacgtctcactttag

SEQ ID NO: 68102 - DNA, 18 bp, synthetic construct
  source 1..18: mol_type = other DNA
aaatacgacaaacaaaag

SEQ ID NO: 68103 - DNA, 18 bp, synthetic construct
  source 1..18: mol_type = other DNA
aaatatgcctttttatag

SEQ ID NO: 68104 - DNA, 18 bp, synthetic construct
  source 1..18: mol_type = other DNA
aattacgactttcaaaag

SEQ ID NO: 68105 - DNA, 18 bp, synthetic construct
  source 1..18: mol_type = other DNA
gatttctgcttactatag

SEQ ID NO: 68106 - DNA, 18 bp, synthetic construct
  source 1..18: mol_type = other DNA
taacacttcccactattg

SEQ ID NO: 68107 - DNA, 18 bp, synthetic construct
  source 1..18: mol_type = other DNA
taataaggctcaaaaccg

SEQ ID NO: 68108 - DNA, 18 bp, synthetic construct
  source 1..18: mol_type = other DNA
taatacgactcaaatatg

SEQ ID NO: 68109 - DNA, 18 bp, synthetic construct
  source 1..18: mol_type = other DNA
taatacgtattgttttag

SEQ ID NO: 68110 - DNA, 18 bp, synthetic construct
  source 1..18: mol_type = other DNA
taatcggcatcacaaatg

SEQ ID NO: 68111 - DNA, 18 bp, synthetic construct
  source 1..18: mol_type = other DNA
tatcacgactcacttgtg

SEQ ID NO: 68112 - DNA, 18 bp, synthetic construct
  source 1..18: mol_type = other DNA
tattacgtcactctttag

SEQ ID NO: 68113 - DNA, 18 bp, synthetic construct
  source 1..18: mol_type = other DNA
tgttacgacgctctattg

SEQ ID NO: 68114 - DNA, 18 bp, synthetic construct
  source 1..18: mol_type = other DNA
ttaaacgactcattactg

SEQ ID NO: 68115 - DNA, 18 bp, synthetic construct
  source 1..18: mol_type = other DNA
ttatactatttactaaag

SEQ ID NO: 68116 - DNA, 18 bp, synthetic construct
  source 1..18: mol_type = other DNA
ttatccgtataacactag

SEQ ID NO: 68117 - DNA, 18 bp, synthetic construct
  source 1..18: mol_type = other DNA
tttcacggctcattctag

SEQ ID NO: 68118 - DNA, 18 bp, synthetic construct
  source 1..18: mol_type = other DNA
ttttaccacacactaaag

SEQ ID NO: 68119 - DNA, 18 bp, synthetic construct
  source 1..18: mol_type = other DNA
ttttacgatatactatag

SEQ ID NO: 68120 - DNA, 18 bp, synthetic construct
  source 1..18: mol_type = other DNA
tttttcgattcactttag

SEQ ID NO: 68121 - DNA, 18 bp, synthetic construct
  source 1..18: mol_type = other DNA
aaaaacgaatctaataag

SEQ ID NO: 68122 - DNA, 18 bp, synthetic construct
  source 1..18: mol_type = other DNA
aaaaacgacacacctcag

SEQ ID NO: 68123 - DNA, 18 bp, synthetic construct
  source 1..18: mol_type = other DNA
aaaaacgacctattacag

SEQ ID NO: 68124 - DNA, 18 bp, synthetic construct
  source 1..18: mol_type = other DNA
aaaaacgacttaccaaag

SEQ ID NO: 68125 - DNA, 18 bp, synthetic construct
  source 1..18: mol_type = other DNA
aaaaaggattcaccatag

SEQ ID NO: 68126 - DNA, 18 bp, synthetic construct
  source 1..18: mol_type = other DNA
aaaaaggtgatacttaag

SEQ ID NO: 68127 - DNA, 18 bp, synthetic construct
  source 1..18: mol_type = other DNA
aaaaatgagtcactttag

SEQ ID NO: 68128 - DNA, 18 bp, synthetic construct
  source 1..18: mol_type = other DNA
aaaaccgactcacgttag

SEQ ID NO: 68129 - DNA, 18 bp, synthetic construct
  source 1..18: mol_type = other DNA
aaaatagactcactaaag

SEQ ID NO: 68130 - DNA, 18 bp, synthetic construct
  source 1..18: mol_type = other DNA
aaaatcgactcacaaaag

SEQ ID NO: 68131 - DNA, 18 bp, synthetic construct
  source 1..18: mol_type = other DNA
aaaatcggatcaatatag

SEQ ID NO: 68132 - DNA, 18 bp, synthetic construct
  source 1..18: mol_type = other DNA
aaacacgtctcacactag

SEQ ID NO: 68133 - DNA, 18 bp, synthetic construct
  source 1..18: mol_type = other DNA
aaacacgtctcactactg

SEQ ID NO: 68134 - DNA, 18 bp, synthetic construct
  source 1..18: mol_type = other DNA
aaacactactcaaaatag

SEQ ID NO: 68135 - DNA, 18 bp, synthetic construct
  source 1..18: mol_type = other DNA
aaacatgactatcatttg

SEQ ID NO: 68136 - DNA, 18 bp, synthetic construct
  source 1..18: mol_type = other DNA
aaacatgtctctctatcg

SEQ ID NO: 68137 - DNA, 18 bp, synthetic construct
  source 1..18: mol_type = other DNA
aaactcgcctcactttcg

SEQ ID NO: 68138 - DNA, 18 bp, synthetic construct
  source 1..18: mol_type = other DNA
aaagaccattcactagag

SEQ ID NO: 68139 - DNA, 18 bp, synthetic construct
  source 1..18: mol_type = other DNA
aaagagcaaacgctcttg

SEQ ID NO: 68140 - DNA, 18 bp, synthetic construct
  source 1..18: mol_type = other DNA
aaagaggtgtcacaatag

SEQ ID NO: 68141 - DNA, 18 bp, synthetic construct
  source 1..18: mol_type = other DNA
aaagccgactcaccattg

SEQ ID NO: 68142 - DNA, 18 bp, synthetic construct
  source 1..18: mol_type = other DNA
aaataagaatcgcaatag

SEQ ID NO: 68143 - DNA, 18 bp, synthetic construct
  source 1..18: mol_type = other DNA
aaataagattctctattg

SEQ ID NO: 68144 - DNA, 18 bp, synthetic construct
  source 1..18: mol_type = other DNA
aaataattctaagtttcg

SEQ ID NO: 68145 - DNA, 18 bp, synthetic construct
  source 1..18: mol_type = other DNA
aaatacaatacactttag

SEQ ID NO: 68146 - DNA, 18 bp, synthetic construct
  source 1..18: mol_type = other DNA
aaatacacctctatcatg

SEQ ID NO: 68147 - DNA, 18 bp, synthetic construct
  source 1..18: mol_type = other DNA
aaatacatctcacaagag

SEQ ID NO: 68148 - DNA, 18 bp, synthetic construct
  source 1..18: mol_type = other DNA
aaataccactgacattgg

SEQ ID NO: 68149 - DNA, 18 bp, synthetic construct
  source 1..18: mol_type = other DNA
aaataccgctaacattag

SEQ ID NO: 68150 - DNA, 18 bp, synthetic construct
  source 1..18: mol_type = other DNA
aaatacgaataatcatag

SEQ ID NO: 68151 - DNA, 18 bp, synthetic construct
  source 1..18: mol_type = other DNA
aaatacgaatcatcgtag

SEQ ID NO: 68152 - DNA, 18 bp, synthetic construct
  source 1..18: mol_type = other DNA
aaatacgactccttaatg

SEQ ID NO: 68153 - DNA, 18 bp, synthetic construct
  source 1..18: mol_type = other DNA
aaatacgactgatagtag

SEQ ID NO: 68154 - DNA, 18 bp, synthetic construct
  source 1..18: mol_type = other DNA
aaatacgacttataaaag

SEQ ID NO: 68155 - DNA, 18 bp, synthetic construct
  source 1..18: mol_type = other DNA
aaatacgagacactgcag

SEQ ID NO: 68156 - DNA, 18 bp, synthetic construct
  source 1..18: mol_type = other DNA
aaatacgattcacaagtg

SEQ ID NO: 68157 - DNA, 18 bp, synthetic construct
  source 1..18: mol_type = other DNA
aaatacgattctctcttg

SEQ ID NO: 68158 - DNA, 18 bp, synthetic construct
  source 1..18: mol_type = other DNA
aaatacggatctcaatag

SEQ ID NO: 68159 - DNA, 18 bp, synthetic construct
  source 1..18: mol_type = other DNA
aaatacgtatccccaaag

SEQ ID NO: 68160 - DNA, 18 bp, synthetic construct
  source 1..18: mol_type = other DNA
aaatacgtctcgttgtag

SEQ ID NO: 68161 - DNA, 18 bp, synthetic construct
  source 1..18: mol_type = other DNA
aaatacgtctgacttcag

SEQ ID NO: 68162 - DNA, 18 bp, synthetic construct
  source 1..18: mol_type = other DNA
aaatacgtcttacttaag

SEQ ID NO: 68163 - DNA, 18 bp, synthetic construct
  source 1..18: mol_type = other DNA
aaatacgtttaaccagag

SEQ ID NO: 68164 - DNA, 18 bp, synthetic construct
  source 1..18: mol_type = other DNA
aaatacgtttcaatagcg

SEQ ID NO: 68165 - DNA, 18 bp, synthetic construct
  source 1..18: mol_type = other DNA
aaatactactaaataaag

SEQ ID NO: 68166 - DNA, 18 bp, synthetic construct
  source 1..18: mol_type = other DNA
aaatacttcaaactatag

SEQ ID NO: 68167 - DNA, 18 bp, synthetic construct
  source 1..18: mol_type = other DNA
aaatacttcacaaaattg

SEQ ID NO: 68168 - DNA, 18 bp, synthetic construct
  source 1..18: mol_type = other DNA
aaataggacactctttag

SEQ ID NO: 68169 - DNA, 18 bp, synthetic construct
  source 1..18: mol_type = other DNA
aaatatgagttactaatg

SEQ ID NO: 68170 - DNA, 18 bp, synthetic construct
  source 1..18: mol_type = other DNA
aaatatgtctcacttaag

SEQ ID NO: 68171 - DNA, 18 bp, synthetic construct
  source 1..18: mol_type = other DNA
aaatattactcacgattg

SEQ ID NO: 68172 - DNA, 18 bp, synthetic construct
  source 1..18: mol_type = other DNA
aaatcaatctcactatag

SEQ ID NO: 68173 - DNA, 18 bp, synthetic construct
  source 1..18: mol_type = other DNA
aaatcccaatccatttag

SEQ ID NO: 68174 - DNA, 18 bp, synthetic construct
  source 1..18: mol_type = other DNA
aaatccgactagcaatag

SEQ ID NO: 68175 - DNA, 18 bp, synthetic construct
  source 1..18: mol_type = other DNA
aaatgcatctcactttgg

SEQ ID NO: 68176 - DNA, 18 bp, synthetic construct
  source 1..18: mol_type = other DNA
aaatgccactcattatgg

SEQ ID NO: 68177 - DNA, 18 bp, synthetic construct
  source 1..18: mol_type = other DNA
aaatgcgactcagttaag

SEQ ID NO: 68178 - DNA, 18 bp, synthetic construct
  source 1..18: mol_type = other DNA
aaatgcgacttccgatag

SEQ ID NO: 68179 - DNA, 18 bp, synthetic construct
  source 1..18: mol_type = other DNA
aaatgcgactttctattg

SEQ ID NO: 68180 - DNA, 18 bp, synthetic construct
  source 1..18: mol_type = other DNA
aaatgctgctcactactg

SEQ ID NO: 68181 - DNA, 18 bp, synthetic construct
  source 1..18: mol_type = other DNA
aaattaaagtcactttag

SEQ ID NO: 68182 - DNA, 18 bp, synthetic construct
  source 1..18: mol_type = other DNA
aaattcgaatcacttttg

SEQ ID NO: 68183 - DNA, 18 bp, synthetic construct
  source 1..18: mol_type = other DNA
aaattcgactaactcttg

SEQ ID NO: 68184 - DNA, 18 bp, synthetic construct
  source 1..18: mol_type = other DNA
aaattcgattctcaatag

SEQ ID NO: 68185 - DNA, 18 bp, synthetic construct
  source 1..18: mol_type = other DNA
aaattcgattttatttag

SEQ ID NO: 68186 - DNA, 18 bp, synthetic construct
  source 1..18: mol_type = other DNA
aaattcgtaacacaatag

SEQ ID NO: 68187 - DNA, 18 bp, synthetic construct
  source 1..18: mol_type = other DNA
aaattcgtcacaatctgg

SEQ ID NO: 68188 - DNA, 18 bp, synthetic construct
  source 1..18: mol_type = other DNA
aaattctacagactatgg

SEQ ID NO: 68189 - DNA, 18 bp, synthetic construct
  source 1..18: mol_type = other DNA
aaattcttagcacttgag

SEQ ID NO: 68190 - DNA, 18 bp, synthetic construct
  source 1..18: mol_type = other DNA
aaattgaactctctatag

SEQ ID NO: 68191 - DNA, 18 bp, synthetic construct
  source 1..18: mol_type = other DNA
aaatttgacacaatattg

SEQ ID NO: 68192 - DNA, 18 bp, synthetic construct
  source 1..18: mol_type = other DNA
aacaacgaatcaataaag

SEQ ID NO: 68193 - DNA, 18 bp, synthetic construct
  source 1..18: mol_type = other DNA
aacaacgtatcactatag

SEQ ID NO: 68194 - DNA, 18 bp, synthetic construct
  source 1..18: mol_type = other DNA
aactacatatcacaaaag

SEQ ID NO: 68195 - DNA, 18 bp, synthetic construct
  source 1..18: mol_type = other DNA
aactacgactctatatgg

SEQ ID NO: 68196 - DNA, 18 bp, synthetic construct
  source 1..18: mol_type = other DNA
aactacgactgactccgg

SEQ ID NO: 68197 - DNA, 18 bp, synthetic construct
  source 1..18: mol_type = other DNA
aactacgatataatatag

SEQ ID NO: 68198 - DNA, 18 bp, synthetic construct
  source 1..18: mol_type = other DNA
aactacgattaatttttg

SEQ ID NO: 68199 - DNA, 18 bp, synthetic construct
  source 1..18: mol_type = other DNA
aactacgattcgcgttag

SEQ ID NO: 68200 - DNA, 18 bp, synthetic construct
  source 1..18: mol_type = other DNA
aactacgtctcatgttag

SEQ ID NO: 68201 - DNA, 18 bp, synthetic construct
  source 1..18: mol_type = other DNA
aagaacgactgaccaaag

SEQ ID NO: 68202 - DNA, 18 bp, synthetic construct
  source 1..18: mol_type = other DNA
aagtaagtctcactttag

SEQ ID NO: 68203 - DNA, 18 bp, synthetic construct
  source 1..18: mol_type = other DNA
aagtacgaatcactcaag

SEQ ID NO: 68204 - DNA, 18 bp, synthetic construct
  source 1..18: mol_type = other DNA
aagtacgaattactattg

SEQ ID NO: 68205 - DNA, 18 bp, synthetic construct
  source 1..18: mol_type = other DNA
aagtacgatacactttag

SEQ ID NO: 68206 - DNA, 18 bp, synthetic construct
  source 1..18: mol_type = other DNA
aagtacgtctcagtttgg

SEQ ID NO: 68207 - DNA, 18 bp, synthetic construct
  source 1..18: mol_type = other DNA
aagttcgactctcaatag

SEQ ID NO: 68208 - DNA, 18 bp, synthetic construct
  source 1..18: mol_type = other DNA
aataacgacacattttag

SEQ ID NO: 68209 - DNA, 18 bp, synthetic construct
  source 1..18: mol_type = other DNA
aataacgactcacatttg

SEQ ID NO: 68210 - DNA, 18 bp, synthetic construct
  source 1..18: mol_type = other DNA
aataacgagtcactaagg

SEQ ID NO: 68211 - DNA, 18 bp, synthetic construct
  source 1..18: mol_type = other DNA
aataaggactcactcttg

SEQ ID NO: 68212 - DNA, 18 bp, synthetic construct
  source 1..18: mol_type = other DNA
aatatagactcatagtag

SEQ ID NO: 68213 - DNA, 18 bp, synthetic construct
  source 1..18: mol_type = other DNA
aatatcaatacattaaag

SEQ ID NO: 68214 - DNA, 18 bp, synthetic construct
  source 1..18: mol_type = other DNA
aatcacgtatctataacg

SEQ ID NO: 68215 - DNA, 18 bp, synthetic construct
  source 1..18: mol_type = other DNA
aatgtctatccacttcag

SEQ ID NO: 68216 - DNA, 18 bp, synthetic construct
  source 1..18: mol_type = other DNA
aattaaaacacactctag

SEQ ID NO: 68217 - DNA, 18 bp, synthetic construct
  source 1..18: mol_type = other DNA
aattaagccatactaatg

SEQ ID NO: 68218 - DNA, 18 bp, synthetic construct
  source 1..18: mol_type = other DNA
aattacaacacactacag

SEQ ID NO: 68219 - DNA, 18 bp, synthetic construct
  source 1..18: mol_type = other DNA
aattaccactcgctattg

SEQ ID NO: 68220 - DNA, 18 bp, synthetic construct
  source 1..18: mol_type = other DNA
aattacgaatctgtattg

SEQ ID NO: 68221 - DNA, 18 bp, synthetic construct
  source 1..18: mol_type = other DNA
aattacgactaacaaatg

SEQ ID NO: 68222 - DNA, 18 bp, synthetic construct
  source 1..18: mol_type = other DNA
aattacgactaattgtgg

SEQ ID NO: 68223 - DNA, 18 bp, synthetic construct
  source 1..18: mol_type = other DNA
aattacgagtcactaatg

SEQ ID NO: 68224 - DNA, 18 bp, synthetic construct
  source 1..18: mol_type = other DNA
aattacggcttactactg

SEQ ID NO: 68225 - DNA, 18 bp, synthetic construct
  source 1..18: mol_type = other DNA
aattacgtttcacaatag

SEQ ID NO: 68226 - DNA, 18 bp, synthetic construct
  source 1..18: mol_type = other DNA
aattactcctaactaagg

SEQ ID NO: 68227 - DNA, 18 bp, synthetic construct
  source 1..18: mol_type = other DNA
aattacttctaagatcag

SEQ ID NO: 68228 - DNA, 18 bp, synthetic construct
  source 1..18: mol_type = other DNA
aattataactctttattg

SEQ ID NO: 68229 - DNA, 18 bp, synthetic construct
  source 1..18: mol_type = other DNA
aattataattcattttcg

SEQ ID NO: 68230 - DNA, 18 bp, synthetic construct
  source 1..18: mol_type = other DNA
aattcagactgcgtatcg

SEQ ID NO: 68231 - DNA, 18 bp, synthetic construct
  source 1..18: mol_type = other DNA
aattccgacacacacaag

SEQ ID NO: 68232 - DNA, 18 bp, synthetic construct
  source 1..18: mol_type = other DNA
aattccgacacaccctag

SEQ ID NO: 68233 - DNA, 18 bp, synthetic construct
  source 1..18: mol_type = other DNA
aattccgtctcagcggag

SEQ ID NO: 68234 - DNA, 18 bp, synthetic construct
  source 1..18: mol_type = other DNA
aattgcagctcactatag

SEQ ID NO: 68235 - DNA, 18 bp, synthetic construct
  source 1..18: mol_type = other DNA
aattgcccctcccttcag

SEQ ID NO: 68236 - DNA, 18 bp, synthetic construct
  source 1..18: mol_type = other DNA
aattgcgacattgtttag

SEQ ID NO: 68237 - DNA, 18 bp, synthetic construct
  source 1..18: mol_type = other DNA
aatttagactcgttttag

SEQ ID NO: 68238 - DNA, 18 bp, synthetic construct
  source 1..18: mol_type = other DNA
aatttagccacactttag

SEQ ID NO: 68239 - DNA, 18 bp, synthetic construct
  source 1..18: mol_type = other DNA
aatttcgacactctatag

SEQ ID NO: 68240 - DNA, 18 bp, synthetic construct
  source 1..18: mol_type = other DNA
aatttcgacttaccattg

SEQ ID NO: 68241 - DNA, 18 bp, synthetic construct
  source 1..18: mol_type = other DNA
acatacgactctaaatag

SEQ ID NO: 68242 - DNA, 18 bp, synthetic construct
  source 1..18: mol_type = other DNA
acatatcactcactaaag

SEQ ID NO: 68243 - DNA, 18 bp, synthetic construct
  source 1..18: mol_type = other DNA
acatatgcctaacaatgg

SEQ ID NO: 68244 - DNA, 18 bp, synthetic construct
  source 1..18: mol_type = other DNA
acatccgactggccatag

SEQ ID NO: 68245 - DNA, 18 bp, synthetic construct
  source 1..18: mol_type = other DNA
acatgcgatacactatag

SEQ ID NO: 68246 - DNA, 18 bp, synthetic construct
  source 1..18: mol_type = other DNA
acatgcgtttcccttaag

SEQ ID NO: 68247 - DNA, 18 bp, synthetic construct
  source 1..18: mol_type = other DNA
acttatgattcactatag

SEQ ID NO: 68248 - DNA, 18 bp, synthetic construct
  source 1..18: mol_type = other DNA
agacacgccacactatag

SEQ ID NO: 68249 - DNA, 18 bp, synthetic construct
  source 1..18: mol_type = other DNA
agatagaactcaatatag

SEQ ID NO: 68250 - DNA, 18 bp, synthetic construct
  source 1..18: mol_type = other DNA
agatataactcactttag

SEQ ID NO: 68251 - DNA, 18 bp, synthetic construct
  source 1..18: mol_type = other DNA
agctacgaatcacaaaag

SEQ ID NO: 68252 - DNA, 18 bp, synthetic construct
  source 1..18: mol_type = other DNA
aggaacgactccctatag

SEQ ID NO: 68253 - DNA, 18 bp, synthetic construct
  source 1..18: mol_type = other DNA
agtgcagaccaactatag

SEQ ID NO: 68254 - DNA, 18 bp, synthetic construct
  source 1..18: mol_type = other DNA
agttaccacccactatag

SEQ ID NO: 68255 - DNA, 18 bp, synthetic construct
  source 1..18: mol_type = other DNA
agttacttatcactatag

SEQ ID NO: 68256 - DNA, 18 bp, synthetic construct
  source 1..18: mol_type = other DNA
ataaacgactcgctattg

SEQ ID NO: 68257 - DNA, 18 bp, synthetic construct
  source 1..18: mol_type = other DNA
ataaacgacttactaaag

SEQ ID NO: 68258 - DNA, 18 bp, synthetic construct
  source 1..18: mol_type = other DNA
ataaacgtctcattgtag

SEQ ID NO: 68259 - DNA, 18 bp, synthetic construct
  source 1..18: mol_type = other DNA
atacacaactcgctattg

SEQ ID NO: 68260 - DNA, 18 bp, synthetic construct
  source 1..18: mol_type = other DNA
atacatgattcactaaag

SEQ ID NO: 68261 - DNA, 18 bp, synthetic construct
  source 1..18: mol_type = other DNA
atactcgactctgtatag

SEQ ID NO: 68262 - DNA, 18 bp, synthetic construct
  source 1..18: mol_type = other DNA
atagacgtctcgctatag

SEQ ID NO: 68263 - DNA, 18 bp, synthetic construct
  source 1..18: mol_type = other DNA
atatacaaaacactatag

SEQ ID NO: 68264 - DNA, 18 bp, synthetic construct
  source 1..18: mol_type = other DNA
atatacctctttctatag

SEQ ID NO: 68265 - DNA, 18 bp, synthetic construct
  source 1..18: mol_type = other DNA
atatacgaaattctatag

SEQ ID NO: 68266 - DNA, 18 bp, synthetic construct
  source 1..18: mol_type = other DNA
atatacgactcaaaaatg

SEQ ID NO: 68267 - DNA, 18 bp, synthetic construct
  source 1..18: mol_type = other DNA
atatacgactcactgatg

SEQ ID NO: 68268 - DNA, 18 bp, synthetic construct
  source 1..18: mol_type = other DNA
atatacgactcatcttgg

SEQ ID NO: 68269 - DNA, 18 bp, synthetic construct
  source 1..18: mol_type = other DNA
atatacgactctcaatgg

SEQ ID NO: 68270 - DNA, 18 bp, synthetic construct
  source 1..18: mol_type = other DNA
atatacgatttttaaaag

SEQ ID NO: 68271 - DNA, 18 bp, synthetic construct
  source 1..18: mol_type = other DNA
atatactactcaaaactg

SEQ ID NO: 68272 - DNA, 18 bp, synthetic construct
  source 1..18: mol_type = other DNA
atatactactcactctgg

SEQ ID NO: 68273 - DNA, 18 bp, synthetic construct
  source 1..18: mol_type = other DNA
atatactagtcactttag

SEQ ID NO: 68274 - DNA, 18 bp, synthetic construct
  source 1..18: mol_type = other DNA
atatatgattcactacag

SEQ ID NO: 68275 - DNA, 18 bp, synthetic construct
  source 1..18: mol_type = other DNA
atatatgctttagtatag

SEQ ID NO: 68276 - DNA, 18 bp, synthetic construct
  source 1..18: mol_type = other DNA
atatccgagtcgctatag

SEQ ID NO: 68277 - DNA, 18 bp, synthetic construct
  source 1..18: mol_type = other DNA
atatccgcctcgttattg

SEQ ID NO: 68278 - DNA, 18 bp, synthetic construct
  source 1..18: mol_type = other DNA
atatgctactctcaaatg

SEQ ID NO: 68279 - DNA, 18 bp, synthetic construct
  source 1..18: mol_type = other DNA
atattcgacacgatttag

SEQ ID NO: 68280 - DNA, 18 bp, synthetic construct
  source 1..18: mol_type = other DNA
atattcgactaacaatag

SEQ ID NO: 68281 - DNA, 18 bp, synthetic construct
  source 1..18: mol_type = other DNA
atattcgactctctattg

SEQ ID NO: 68282 - DNA, 18 bp, synthetic construct
  source 1..18: mol_type = other DNA
atatttgactgagtttcg

SEQ ID NO: 68283 - DNA, 18 bp, synthetic construct
  source 1..18: mol_type = other DNA
atctacgactcgctattg

SEQ ID NO: 68284 - DNA, 18 bp, synthetic construct
  source 1..18: mol_type = other DNA
atctacgtcacattatag

SEQ ID NO: 68285 - DNA, 18 bp, synthetic construct
  source 1..18: mol_type = other DNA
atctaggactcactaatg

SEQ ID NO: 68286 - DNA, 18 bp, synthetic construct
  source 1..18: mol_type = other DNA
atgcacaactcaataatg

SEQ ID NO: 68287 - DNA, 18 bp, synthetic construct
  source 1..18: mol_type = other DNA
atggaagacttaataagg

SEQ ID NO: 68288 - DNA, 18 bp, synthetic construct
  source 1..18: mol_type = other DNA
atgtacgaatcacaattg

SEQ ID NO: 68289 - DNA, 18 bp, synthetic construct
  source 1..18: mol_type = other DNA
attaacgtcgcactaatg

SEQ ID NO: 68290 - DNA, 18 bp, synthetic construct
  source 1..18: mol_type = other DNA
attcgcgattcactatag

SEQ ID NO: 68291 - DNA, 18 bp, synthetic construct
  source 1..18: mol_type = other DNA
atttacgaaacacggaag

SEQ ID NO: 68292 - DNA, 18 bp, synthetic construct
  source 1..18: mol_type = other DNA
atttacgaatcccttatg

SEQ ID NO: 68293 - DNA, 18 bp, synthetic construct
  source 1..18: mol_type = other DNA
atttacgacacattatag

SEQ ID NO: 68294 - DNA, 18 bp, synthetic construct
  source 1..18: mol_type = other DNA
atttacgactctcagtag

SEQ ID NO: 68295 - DNA, 18 bp, synthetic construct
  source 1..18: mol_type = other DNA
atttacgactgcctaaag

SEQ ID NO: 68296 - DNA, 18 bp, synthetic construct
  source 1..18: mol_type = other DNA
atttacttctcactaaag

SEQ ID NO: 68297 - DNA, 18 bp, synthetic construct
  source 1..18: mol_type = other DNA
atttagaactcagatagg

SEQ ID NO: 68298 - DNA, 18 bp, synthetic construct
  source 1..18: mol_type = other DNA
caaaacaacttactaaag

SEQ ID NO: 68299 - DNA, 18 bp, synthetic construct
  source 1..18: mol_type = other DNA
caaaacggttttctatcg

SEQ ID NO: 68300 - DNA, 18 bp, synthetic construct
  source 1..18: mol_type = other DNA
caaaacgtatcaatatag

SEQ ID NO: 68301 - DNA, 18 bp, synthetic construct
  source 1..18: mol_type = other DNA
caaaataactcgatcaag

SEQ ID NO: 68302 - DNA, 18 bp, synthetic construct
  source 1..18: mol_type = other DNA
caacacatctcactttag

SEQ ID NO: 68303 - DNA, 18 bp, synthetic construct
  source 1..18: mol_type = other DNA
caacatgacacacgaaag

SEQ ID NO: 68304 - DNA, 18 bp, synthetic construct
  source 1..18: mol_type = other DNA
caactcgatacatcaatg

SEQ ID NO: 68305 - DNA, 18 bp, synthetic construct
  source 1..18: mol_type = other DNA
caactcgcctcattattg

SEQ ID NO: 68306 - DNA, 18 bp, synthetic construct
  source 1..18: mol_type = other DNA
caagccgactaactcttg

SEQ ID NO: 68307 - DNA, 18 bp, synthetic construct
  source 1..18: mol_type = other DNA
caataaaaatcaattgag

SEQ ID NO: 68308 - DNA, 18 bp, synthetic construct
  source 1..18: mol_type = other DNA
caataagtcacattattg

SEQ ID NO: 68309 - DNA, 18 bp, synthetic construct
  source 1..18: mol_type = other DNA
caatacgactcctttaag

SEQ ID NO: 68310 - DNA, 18 bp, synthetic construct
  source 1..18: mol_type = other DNA
caatacgagtcattaacg

SEQ ID NO: 68311 - DNA, 18 bp, synthetic construct
  source 1..18: mol_type = other DNA
caatacgattcacttatg

SEQ ID NO: 68312 - DNA, 18 bp, synthetic construct
  source 1..18: mol_type = other DNA
caatacgccactcaatag

SEQ ID NO: 68313 - DNA, 18 bp, synthetic construct
  source 1..18: mol_type = other DNA
caatacgcctttcttcag

SEQ ID NO: 68314 - DNA, 18 bp, synthetic construct
  source 1..18: mol_type = other DNA
caatacgtatccttatag

SEQ ID NO: 68315 - DNA, 18 bp, synthetic construct
  source 1..18: mol_type = other DNA
caatacgtctctccaaag

SEQ ID NO: 68316 - DNA, 18 bp, synthetic construct
  source 1..18: mol_type = other DNA
caatactaattgttttag

SEQ ID NO: 68317 - DNA, 18 bp, synthetic construct
  source 1..18: mol_type = other DNA
caatactacatactttag

SEQ ID NO: 68318 - DNA, 18 bp, synthetic construct
  source 1..18: mol_type = other DNA
caatactcatctcatatg

SEQ ID NO: 68319 - DNA, 18 bp, synthetic construct
  source 1..18: mol_type = other DNA
caatagctctcccaacag

SEQ ID NO: 68320 - DNA, 18 bp, synthetic construct
  source 1..18: mol_type = other DNA
caatcatactctcgatag

SEQ ID NO: 68321 - DNA, 18 bp, synthetic construct
  source 1..18: mol_type = other DNA
caatccaaatcactacag

SEQ ID NO: 68322 - DNA, 18 bp, synthetic construct
  source 1..18: mol_type = other DNA
caatccgacacaataaag

SEQ ID NO: 68323 - DNA, 18 bp, synthetic construct
  source 1..18: mol_type = other DNA
caatccgtttcgttttcg

SEQ ID NO: 68324 - DNA, 18 bp, synthetic construct
  source 1..18: mol_type = other DNA
caatcgggctagcaatag

SEQ ID NO: 68325 - DNA, 18 bp, synthetic construct
  source 1..18: mol_type = other DNA
caatcggtcattctatag

SEQ ID NO: 68326 - DNA, 18 bp, synthetic construct
  source 1..18: mol_type = other DNA
caatctgactctatacag

SEQ ID NO: 68327 - DNA, 18 bp, synthetic construct
  source 1..18: mol_type = other DNA
caattagtctcacttcag

SEQ ID NO: 68328 - DNA, 18 bp, synthetic construct
  source 1..18: mol_type = other DNA
caattcaactcattttag

SEQ ID NO: 68329 - DNA, 18 bp, synthetic construct
  source 1..18: mol_type = other DNA
caattccagtctctaaag

SEQ ID NO: 68330 - DNA, 18 bp, synthetic construct
  source 1..18: mol_type = other DNA
caattcgacactttaaag

SEQ ID NO: 68331 - DNA, 18 bp, synthetic construct
  source 1..18: mol_type = other DNA
caattcgatacactgtag

SEQ ID NO: 68332 - DNA, 18 bp, synthetic construct
  source 1..18: mol_type = other DNA
caattcgattcactactg

SEQ ID NO: 68333 - DNA, 18 bp, synthetic construct
  source 1..18: mol_type = other DNA
caatttgactcacaattg

SEQ ID NO: 68334 - DNA, 18 bp, synthetic construct
  source 1..18: mol_type = other DNA
cacctccacacgctttcg

SEQ ID NO: 68335 - DNA, 18 bp, synthetic construct
  source 1..18: mol_type = other DNA
cactaagagtcatcattg

SEQ ID NO: 68336 - DNA, 18 bp, synthetic construct
  source 1..18: mol_type = other DNA
cactaagtatcactatag

SEQ ID NO: 68337 - DNA, 18 bp, synthetic construct
  source 1..18: mol_type = other DNA
cactacgacttacttttg

SEQ ID NO: 68338 - DNA, 18 bp, synthetic construct
  source 1..18: mol_type = other DNA
cactgcgtctcataatag

SEQ ID NO: 68339 - DNA, 18 bp, synthetic construct
  source 1..18: mol_type = other DNA
cagaaagactcactatgg

SEQ ID NO: 68340 - DNA, 18 bp, synthetic construct
  source 1..18: mol_type = other DNA
cagtatatatcacttttg

SEQ ID NO: 68341 - DNA, 18 bp, synthetic construct
  source 1..18: mol_type = other DNA
cataacgtctccctctag

SEQ ID NO: 68342 - DNA, 18 bp, synthetic construct
  source 1..18: mol_type = other DNA
catcacacctgaattcag

SEQ ID NO: 68343 - DNA, 18 bp, synthetic construct
  source 1..18: mol_type = other DNA
cattaaaccgcactttag

SEQ ID NO: 68344 - DNA, 18 bp, synthetic construct
  source 1..18: mol_type = other DNA
cattacgattcagcattg

SEQ ID NO: 68345 - DNA, 18 bp, synthetic construct
  source 1..18: mol_type = other DNA
cattacgtttcaatttag

SEQ ID NO: 68346 - DNA, 18 bp, synthetic construct
  source 1..18: mol_type = other DNA
cattactacgcactatgg

SEQ ID NO: 68347 - DNA, 18 bp, synthetic construct
  source 1..18: mol_type = other DNA
cattatttctcaatatag

SEQ ID NO: 68348 - DNA, 18 bp, synthetic construct
  source 1..18: mol_type = other DNA
catttcgttttactacga

SEQ ID NO: 68349 - DNA, 18 bp, synthetic construct
  source 1..18: mol_type = other DNA
ccaaaggactctcaatag

SEQ ID NO: 68350 - DNA, 18 bp, synthetic construct
  source 1..18: mol_type = other DNA
ccaccttctacactattg

SEQ ID NO: 68351 - DNA, 18 bp, synthetic construct
  source 1..18: mol_type = other DNA
ccatacatctcactaagg

SEQ ID NO: 68352 - DNA, 18 bp, synthetic construct
  source 1..18: mol_type = other DNA
cccatggactcactctag

SEQ ID NO: 68353 - DNA, 18 bp, synthetic construct
  source 1..18: mol_type = other DNA
cgacactactcgttatcg

SEQ ID NO: 68354 - DNA, 18 bp, synthetic construct
  source 1..18: mol_type = other DNA
cgatacaccatactatag

SEQ ID NO: 68355 - DNA, 18 bp, synthetic construct
  source 1..18: mol_type = other DNA
cgataccactcacgaaag

SEQ ID NO: 68356 - DNA, 18 bp, synthetic construct
  source 1..18: mol_type = other DNA
cgatagaacttctaatag

SEQ ID NO: 68357 - DNA, 18 bp, synthetic construct
  source 1..18: mol_type = other DNA
cgtttcgtctctcaatgg

SEQ ID NO: 68358 - DNA, 18 bp, synthetic construct
  source 1..18: mol_type = other DNA
ctaaacaactcacaatcg

SEQ ID NO: 68359 - DNA, 18 bp, synthetic construct
  source 1..18: mol_type = other DNA
ctataagactcacaacag

SEQ ID NO: 68360 - DNA, 18 bp, synthetic construct
  source 1..18: mol_type = other DNA
ctatacatctcgctttag

SEQ ID NO: 68361 - DNA, 18 bp, synthetic construct
  source 1..18: mol_type = other DNA
ctatatgacacaccatag

SEQ ID NO: 68362 - DNA, 18 bp, synthetic construct
  source 1..18: mol_type = other DNA
ctattcatctcaccattg

SEQ ID NO: 68363 - DNA, 18 bp, synthetic construct
  source 1..18: mol_type = other DNA
ctatttgactgactaaag

SEQ ID NO: 68364 - DNA, 18 bp, synthetic construct
  source 1..18: mol_type = other DNA
ctcaacgactaacttatg

SEQ ID NO: 68365 - DNA, 18 bp, synthetic construct
  source 1..18: mol_type = other DNA
ctctacgactaactaaag

SEQ ID NO: 68366 - DNA, 18 bp, synthetic construct
  source 1..18: mol_type = other DNA
ctctatgacactccaaag

SEQ ID NO: 68367 - DNA, 18 bp, synthetic construct
  source 1..18: mol_type = other DNA
ctctatgactcactattg

SEQ ID NO: 68368 - DNA, 18 bp, synthetic construct
  source 1..18: mol_type = other DNA
ctggaagactctttatag

SEQ ID NO: 68369 - DNA, 18 bp, synthetic construct
  source 1..18: mol_type = other DNA
ctgtacgactcgctaagg

SEQ ID NO: 68370 - DNA, 18 bp, synthetic construct
  source 1..18: mol_type = other DNA
cttatactctcacttttg

SEQ ID NO: 68371 - DNA, 18 bp, synthetic construct
  source 1..18: mol_type = other DNA
ctttacgactctctctag

SEQ ID NO: 68372 - DNA, 18 bp, synthetic construct
  source 1..18: mol_type = other DNA
gaaaaagaaactctaaag

SEQ ID NO: 68373 - DNA, 18 bp, synthetic construct
  source 1..18: mol_type = other DNA
gaacactacatactagag

SEQ ID NO: 68374 - DNA, 18 bp, synthetic construct
  source 1..18: mol_type = other DNA
gaacccgactgtctaagg

SEQ ID NO: 68375 - DNA, 18 bp, synthetic construct
  source 1..18: mol_type = other DNA
gaataagacttacatatg

SEQ ID NO: 68376 - DNA, 18 bp, synthetic construct
  source 1..18: mol_type = other DNA
gaataatattgtctttcg

SEQ ID NO: 68377 - DNA, 18 bp, synthetic construct
  source 1..18: mol_type = other DNA
gaatacaattcacaattg

SEQ ID NO: 68378 - DNA, 18 bp, synthetic construct
  source 1..18: mol_type = other DNA
gaatacaattgaccaaag

SEQ ID NO: 68379 - DNA, 18 bp, synthetic construct
  source 1..18: mol_type = other DNA
gaataggactctcttttg

SEQ ID NO: 68380 - DNA, 18 bp, synthetic construct
  source 1..18: mol_type = other DNA
gaatatatcacactacag

SEQ ID NO: 68381 - DNA, 18 bp, synthetic construct
  source 1..18: mol_type = other DNA
gaatatatctcacaatag

SEQ ID NO: 68382 - DNA, 18 bp, synthetic construct
  source 1..18: mol_type = other DNA
gaatatgaccctcagtag

SEQ ID NO: 68383 - DNA, 18 bp, synthetic construct
  source 1..18: mol_type = other DNA
gaatatgtcttcgttttg

SEQ ID NO: 68384 - DNA, 18 bp, synthetic construct
  source 1..18: mol_type = other DNA
gaattagacactcttcag

SEQ ID NO: 68385 - DNA, 18 bp, synthetic construct
  source 1..18: mol_type = other DNA
gaattagcctcacaatag

SEQ ID NO: 68386 - DNA, 18 bp, synthetic construct
  source 1..18: mol_type = other DNA
gaattcgactatttttag

SEQ ID NO: 68387 - DNA, 18 bp, synthetic construct
  source 1..18: mol_type = other DNA
gactgtgtcactctattg

SEQ ID NO: 68388 - DNA, 18 bp, synthetic construct
  source 1..18: mol_type = other DNA
gagtacgtctcaatattg

SEQ ID NO: 68389 - DNA, 18 bp, synthetic construct
  source 1..18: mol_type = other DNA
gagtacgtctcacttcag

SEQ ID NO: 68390 - DNA, 18 bp, synthetic construct
  source 1..18: mol_type = other DNA
gatatggattctctatag

SEQ ID NO: 68391 - DNA, 18 bp, synthetic construct
  source 1..18: mol_type = other DNA
gcatactacgctcaatag

SEQ ID NO: 68392 - DNA, 18 bp, synthetic construct
  source 1..18: mol_type = other DNA
ggctacgactctctaaag

SEQ ID NO: 68393 - DNA, 18 bp, synthetic construct
  source 1..18: mol_type = other DNA
gtataagactccctaaag

SEQ ID NO: 68394 - DNA, 18 bp, synthetic construct
  source 1..18: mol_type = other DNA
gtatacgacttagtgtag

SEQ ID NO: 68395 - DNA, 18 bp, synthetic construct
  source 1..18: mol_type = other DNA
gtatccgcctctcaatag

SEQ ID NO: 68396 - DNA, 18 bp, synthetic construct
  source 1..18: mol_type = other DNA
gtattcgacacactattg

SEQ ID NO: 68397 - DNA, 18 bp, synthetic construct
  source 1..18: mol_type = other DNA
gtttaggactcacctaag

SEQ ID NO: 68398 - DNA, 18 bp, synthetic construct
  source 1..18: mol_type = other DNA
taaaaagactaactgttg

SEQ ID NO: 68399 - DNA, 18 bp, synthetic construct
  source 1..18: mol_type = other DNA
taaaaagactcgtaatcg

SEQ ID NO: 68400 - DNA, 18 bp, synthetic construct
  source 1..18: mol_type = other DNA
taaaaagagtcaccttag

SEQ ID NO: 68401 - DNA, 18 bp, synthetic construct
  source 1..18: mol_type = other DNA
taaaaagattcgctttag

SEQ ID NO: 68402 - DNA, 18 bp, synthetic construct
  source 1..18: mol_type = other DNA
taaaaaggttcacaatag

SEQ ID NO: 68403 - DNA, 18 bp, synthetic construct
  source 1..18: mol_type = other DNA
taaaaattctctctacag

SEQ ID NO: 68404 - DNA, 18 bp, synthetic construct
  source 1..18: mol_type = other DNA
taaaacacctcaataaag

SEQ ID NO: 68405 - DNA, 18 bp, synthetic construct
  source 1..18: mol_type = other DNA
taaaacagatcacactag

SEQ ID NO: 68406 - DNA, 18 bp, synthetic construct
  source 1..18: mol_type = other DNA
taaaacctctcacgaaag

SEQ ID NO: 68407 - DNA, 18 bp, synthetic construct
  source 1..18: mol_type = other DNA
taaaacgacccgataaag

SEQ ID NO: 68408 - DNA, 18 bp, synthetic construct
  source 1..18: mol_type = other DNA
taaaacgactctcattgg

SEQ ID NO: 68409 - DNA, 18 bp, synthetic construct
  source 1..18: mol_type = other DNA
taaaacgactgccaatcg

SEQ ID NO: 68410 - DNA, 18 bp, synthetic construct
  source 1..18: mol_type = other DNA
taaaacgacttcttaaag

SEQ ID NO: 68411 - DNA, 18 bp, synthetic construct
  source 1..18: mol_type = other DNA
taaaacgattcacttatg

SEQ ID NO: 68412 - DNA, 18 bp, synthetic construct
  source 1..18: mol_type = other DNA
taaaacgcgtctctaatg

SEQ ID NO: 68413 - DNA, 18 bp, synthetic construct
  source 1..18: mol_type = other DNA
taaaacgtatcacttttg

SEQ ID NO: 68414 - DNA, 18 bp, synthetic construct
  source 1..18: mol_type = other DNA
taaaacgtcacacattcg

SEQ ID NO: 68415 - DNA, 18 bp, synthetic construct
  source 1..18: mol_type = other DNA
taaaacgtcgcacaattg

SEQ ID NO: 68416 - DNA, 18 bp, synthetic construct
  source 1..18: mol_type = other DNA
taaaacgtctaacctttg

SEQ ID NO: 68417 - DNA, 18 bp, synthetic construct
  source 1..18: mol_type = other DNA
taaaacgtctcatgttcg

SEQ ID NO: 68418 - DNA, 18 bp, synthetic construct
  source 1..18: mol_type = other DNA
taaaacgtctgactactg

SEQ ID NO: 68419 - DNA, 18 bp, synthetic construct
  source 1..18: mol_type = other DNA
taaaactagtcgctttag

SEQ ID NO: 68420 - DNA, 18 bp, synthetic construct
  source 1..18: mol_type = other DNA
taaaactgcacccaagag

SEQ ID NO: 68421 - DNA, 18 bp, synthetic construct
  source 1..18: mol_type = other DNA
taaaacttttcacaatag

SEQ ID NO: 68422 - DNA, 18 bp, synthetic construct
  source 1..18: mol_type = other DNA
taaaaggactcctgattg

SEQ ID NO: 68423 - DNA, 18 bp, synthetic construct
  source 1..18: mol_type = other DNA
taaaatgacaaatgatag

SEQ ID NO: 68424 - DNA, 18 bp, synthetic construct
  source 1..18: mol_type = other DNA
taaaatggatctctatag

SEQ ID NO: 68425 - DNA, 18 bp, synthetic construct
  source 1..18: mol_type = other DNA
taaaattactctctctag

SEQ ID NO: 68426 - DNA, 18 bp, synthetic construct
  source 1..18: mol_type = other DNA
taaacagacacacaattg

SEQ ID NO: 68427 - DNA, 18 bp, synthetic construct
  source 1..18: mol_type = other DNA
taaaccgacgcactaatg

SEQ ID NO: 68428 - DNA, 18 bp, synthetic construct
  source 1..18: mol_type = other DNA
taaaccgactctgattag

SEQ ID NO: 68429 - DNA, 18 bp, synthetic construct
  source 1..18: mol_type = other DNA
taaaccgtttcaccaaag

SEQ ID NO: 68430 - DNA, 18 bp, synthetic construct
  source 1..18: mol_type = other DNA
taaagcaactcactaagg

SEQ ID NO: 68431 - DNA, 18 bp, synthetic construct
  source 1..18: mol_type = other DNA
taaagcaattaactttag

SEQ ID NO: 68432 - DNA, 18 bp, synthetic construct
  source 1..18: mol_type = other DNA
taaagccactgactttcg

SEQ ID NO: 68433 - DNA, 18 bp, synthetic construct
  source 1..18: mol_type = other DNA
taaagctactctcaatag

SEQ ID NO: 68434 - DNA, 18 bp, synthetic construct
  source 1..18: mol_type = other DNA
taaagtgtattactattg

SEQ ID NO: 68435 - DNA, 18 bp, synthetic construct
  source 1..18: mol_type = other DNA
taaataggcactttatag

SEQ ID NO: 68436 - DNA, 18 bp, synthetic construct
  source 1..18: mol_type = other DNA
taaatcaaaacactaaag

SEQ ID NO: 68437 - DNA, 18 bp, synthetic construct
  source 1..18: mol_type = other DNA
taaatcgacatattttag

SEQ ID NO: 68438 - DNA, 18 bp, synthetic construct
  source 1..18: mol_type = other DNA
taaatcgactcgcaaacg

SEQ ID NO: 68439 - DNA, 18 bp, synthetic construct
  source 1..18: mol_type = other DNA
taaatcgacttactaatg

SEQ ID NO: 68440 - DNA, 18 bp, synthetic construct
  source 1..18: mol_type = other DNA
taaatcgactttcgaacg

SEQ ID NO: 68441 - DNA, 18 bp, synthetic construct
  source 1..18: mol_type = other DNA
taaatcgagtctctaaag

SEQ ID NO: 68442 - DNA, 18 bp, synthetic construct
  source 1..18: mol_type = other DNA
taaatcggctcacaattg

SEQ ID NO: 68443 - DNA, 18 bp, synthetic construct
  source 1..18: mol_type = other DNA
taaatctaaacactctag

SEQ ID NO: 68444 - DNA, 18 bp, synthetic construct
  source 1..18: mol_type = other DNA
taaatctactcattgttg

SEQ ID NO: 68445 - DNA, 18 bp, synthetic construct
  source 1..18: mol_type = other DNA
taaatcttctcactaaag

SEQ ID NO: 68446 - DNA, 18 bp, synthetic construct
  source 1..18: mol_type = other DNA
taaatggggccactattg

SEQ ID NO: 68447 - DNA, 18 bp, synthetic construct
  source 1..18: mol_type = other DNA
taaatggtctcactttcg

SEQ ID NO: 68448 - DNA, 18 bp, synthetic construct
  source 1..18: mol_type = other DNA
taaattgactcacattag

SEQ ID NO: 68449 - DNA, 18 bp, synthetic construct
  source 1..18: mol_type = other DNA
taaattgattcacaagag

SEQ ID NO: 68450 - DNA, 18 bp, synthetic construct
  source 1..18: mol_type = other DNA
taacaagactctttttag

SEQ ID NO: 68451 - DNA, 18 bp, synthetic construct
  source 1..18: mol_type = other DNA
taacacctgtaaccctag

SEQ ID NO: 68452 - DNA, 18 bp, synthetic construct
  source 1..18: mol_type = other DNA
taacacgacacacacctg

SEQ ID NO: 68453 - DNA, 18 bp, synthetic construct
  source 1..18: mol_type = other DNA
taacacgacacatcacag

SEQ ID NO: 68454 - DNA, 18 bp, synthetic construct
  source 1..18: mol_type = other DNA
taacacggcactccatag

SEQ ID NO: 68455 - DNA, 18 bp, synthetic construct
  source 1..18: mol_type = other DNA
taacagtactctctctag

SEQ ID NO: 68456 - DNA, 18 bp, synthetic construct
  source 1..18: mol_type = other DNA
taacatcacactcaaagg

SEQ ID NO: 68457 - DNA, 18 bp, synthetic construct
  source 1..18: mol_type = other DNA
taacatgaaccgctattg

SEQ ID NO: 68458 - DNA, 18 bp, synthetic construct
  source 1..18: mol_type = other DNA
taacatgatcgactatag

SEQ ID NO: 68459 - DNA, 18 bp, synthetic construct
  source 1..18: mol_type = other DNA
taaccagactctctattg

SEQ ID NO: 68460 - DNA, 18 bp, synthetic construct
  source 1..18: mol_type = other DNA
taacgatacacactatag

SEQ ID NO: 68461 - DNA, 18 bp, synthetic construct
  source 1..18: mol_type = other DNA
taacgcaactcactgatg

SEQ ID NO: 68462 - DNA, 18 bp, synthetic construct
  source 1..18: mol_type = other DNA
taactagactcacaacag

SEQ ID NO: 68463 - DNA, 18 bp, synthetic construct
  source 1..18: mol_type = other DNA
taactatactcacttcgg

SEQ ID NO: 68464 - DNA, 18 bp, synthetic construct
  source 1..18: mol_type = other DNA
taactcaattcactattg

SEQ ID NO: 68465 - DNA, 18 bp, synthetic construct
  source 1..18: mol_type = other DNA
taactcgactttctaaag

SEQ ID NO: 68466 - DNA, 18 bp, synthetic construct
  source 1..18: mol_type = other DNA
taactcgatttactatcg

SEQ ID NO: 68467 - DNA, 18 bp, synthetic construct
  source 1..18: mol_type = other DNA
taactgtactttcaatag

SEQ ID NO: 68468 - DNA, 18 bp, synthetic construct
  source 1..18: mol_type = other DNA
taacttgtctgactatag

SEQ ID NO: 68469 - DNA, 18 bp, synthetic construct
  source 1..18: mol_type = other DNA
taagacgacactcttcag

SEQ ID NO: 68470 - DNA, 18 bp, synthetic construct
  source 1..18: mol_type = other DNA
taagatgatttactattg

SEQ ID NO: 68471 - DNA, 18 bp, synthetic construct
  source 1..18: mol_type = other DNA
taagtagactctatttag

SEQ ID NO: 68472 - DNA, 18 bp, synthetic construct
  source 1..18: mol_type = other DNA
taagtcgtctttctatag

SEQ ID NO: 68473 - DNA, 18 bp, synthetic construct
  source 1..18: mol_type = other DNA
taataacactcccttaag

SEQ ID NO: 68474 - DNA, 18 bp, synthetic construct
  source 1..18: mol_type = other DNA
taataagacaatctttag

SEQ ID NO: 68475 - DNA, 18 bp, synthetic construct
  source 1..18: mol_type = other DNA
taataagacacatgattg

SEQ ID NO: 68476 - DNA, 18 bp, synthetic construct
  source 1..18: mol_type = other DNA
taataagacgacctaaag

SEQ ID NO: 68477 - DNA, 18 bp, synthetic construct
  source 1..18: mol_type = other DNA
taataagacttattaacg

SEQ ID NO: 68478 - DNA, 18 bp, synthetic construct
  source 1..18: mol_type = other DNA
taataagactttttacag

SEQ ID NO: 68479 - DNA, 18 bp, synthetic construct
  source 1..18: mol_type = other DNA
taataagtcatacgattg

SEQ ID NO: 68480 - DNA, 18 bp, synthetic construct
  source 1..18: mol_type = other DNA
taataatacactccatag

SEQ ID NO: 68481 - DNA, 18 bp, synthetic construct
  source 1..18: mol_type = other DNA
taatacaaaactcaaaag

SEQ ID NO: 68482 - DNA, 18 bp, synthetic construct
  source 1..18: mol_type = other DNA
taatacaaatcctttaag

SEQ ID NO: 68483 - DNA, 18 bp, synthetic construct
  source 1..18: mol_type = other DNA
taatacaacaatctctag

SEQ ID NO: 68484 - DNA, 18 bp, synthetic construct
  source 1..18: mol_type = other DNA
taatacaacatactgggg

SEQ ID NO: 68485 - DNA, 18 bp, synthetic construct
  source 1..18: mol_type = other DNA
taatacaactaagttatg

SEQ ID NO: 68486 - DNA, 18 bp, synthetic construct
  source 1..18: mol_type = other DNA
taatacaactggtcacgg

SEQ ID NO: 68487 - DNA, 18 bp, synthetic construct
  source 1..18: mol_type = other DNA
taatacaacttaatagcg

SEQ ID NO: 68488 - DNA, 18 bp, synthetic construct
  source 1..18: mol_type = other DNA
taatacaacttatttcag

SEQ ID NO: 68489 - DNA, 18 bp, synthetic construct
  source 1..18: mol_type = other DNA
taatacaacttcgttacg

SEQ ID NO: 68490 - DNA, 18 bp, synthetic construct
  source 1..18: mol_type = other DNA
taatacaccaaactattg

SEQ ID NO: 68491 - DNA, 18 bp, synthetic construct
  source 1..18: mol_type = other DNA
taatacataaccatctag

SEQ ID NO: 68492 - DNA, 18 bp, synthetic construct
  source 1..18: mol_type = other DNA
taatacatcctactatcg

SEQ ID NO: 68493 - DNA, 18 bp, synthetic construct
  source 1..18: mol_type = other DNA
taatacatctatcaaaag

SEQ ID NO: 68494 - DNA, 18 bp, synthetic construct
  source 1..18: mol_type = other DNA
taatacatctcacatgag

SEQ ID NO: 68495 - DNA, 18 bp, synthetic construct
  source 1..18: mol_type = other DNA
taatacatgtctctattg

SEQ ID NO: 68496 - DNA, 18 bp, synthetic construct
  source 1..18: mol_type = other DNA
taataccactcacaaata

SEQ ID NO: 68497 - DNA, 18 bp, synthetic construct
  source 1..18: mol_type = other DNA
taataccactctaaaaag

SEQ ID NO: 68498 - DNA, 18 bp, synthetic construct
  source 1..18: mol_type = other DNA
taataccatccaatattg

SEQ ID NO: 68499 - DNA, 18 bp, synthetic construct
  source 1..18: mol_type = other DNA
taatacccacaaatatag

SEQ ID NO: 68500 - DNA, 18 bp, synthetic construct
  source 1..18: mol_type = other DNA
taatacctcacactttgg

SEQ ID NO: 68501 - DNA, 18 bp, synthetic construct
  source 1..18: mol_type = other DNA
taatacctctccatattg

SEQ ID NO: 68502 - DNA, 18 bp, synthetic construct
  source 1..18: mol_type = other DNA
taatacctttcaatattg

SEQ ID NO: 68503 - DNA, 18 bp, synthetic construct
  source 1..18: mol_type = other DNA
taatacgaaatacttttg

SEQ ID NO: 68504 - DNA, 18 bp, synthetic construct
  source 1..18: mol_type = other DNA
taatacgacacagttccg

SEQ ID NO: 68505 - DNA, 18 bp, synthetic construct
  source 1..18: mol_type = other DNA
taatacgacacgcagttg

SEQ ID NO: 68506 - DNA, 18 bp, synthetic construct
  source 1..18: mol_type = other DNA
taatacgacactattaag

SEQ ID NO: 68507 - DNA, 18 bp, synthetic construct
  source 1..18: mol_type = other DNA
taatacgacctaccaaaa

SEQ ID NO: 68508 - DNA, 18 bp, synthetic construct
  source 1..18: mol_type = other DNA
taatacgactataaattg

SEQ ID NO: 68509 - DNA, 18 bp, synthetic construct
  source 1..18: mol_type = other DNA
taatacgactattaattg

SEQ ID NO: 68510 - DNA, 18 bp, synthetic construct
  source 1..18: mol_type = other DNA
taatacgactcaacggtg

SEQ ID NO: 68511 - DNA, 18 bp, synthetic construct
  source 1..18: mol_type = other DNA
taatacgactcttgaatg

SEQ ID NO: 68512 - DNA, 18 bp, synthetic construct
  source 1..18: mol_type = other DNA
taatacgactggcataag

SEQ ID NO: 68513 - DNA, 18 bp, synthetic construct
  source 1..18: mol_type = other DNA
taatacgactgtcaaggg

SEQ ID NO: 68514 - DNA, 18 bp, synthetic construct
  source 1..18: mol_type = other DNA
taatacgagtttcattag

SEQ ID NO: 68515 - DNA, 18 bp, synthetic construct
  source 1..18: mol_type = other DNA
taatacgatccacaaagg

SEQ ID NO: 68516 - DNA, 18 bp, synthetic construct
  source 1..18: mol_type = other DNA
taatacgatttacataag

SEQ ID NO: 68517 - DNA, 18 bp, synthetic construct
  source 1..18: mol_type = other DNA
taatacgatttatttttg

SEQ ID NO: 68518 - DNA, 18 bp, synthetic construct
  source 1..18: mol_type = other DNA
taatacgccatactaccg

SEQ ID NO: 68519 - DNA, 18 bp, synthetic construct
  source 1..18: mol_type = other DNA
taatacgcctttctcttg

SEQ ID NO: 68520 - DNA, 18 bp, synthetic construct
  source 1..18: mol_type = other DNA
taatacgctcaacataag

SEQ ID NO: 68521 - DNA, 18 bp, synthetic construct
  source 1..18: mol_type = other DNA
taatacggaccataatag

SEQ ID NO: 68522 - DNA, 18 bp, synthetic construct
  source 1..18: mol_type = other DNA
taatacggatcagtaatg

SEQ ID NO: 68523 - DNA, 18 bp, synthetic construct
  source 1..18: mol_type = other DNA
taatacggatcttaatag

SEQ ID NO: 68524 - DNA, 18 bp, synthetic construct
  source 1..18: mol_type = other DNA
taatacggggcacagttg

SEQ ID NO: 68525 - DNA, 18 bp, synthetic construct
  source 1..18: mol_type = other DNA
taatacgtattactcgag

SEQ ID NO: 68526 - DNA, 18 bp, synthetic construct
  source 1..18: mol_type = other DNA
taatacgtcaatctatcg

SEQ ID NO: 68527 - DNA, 18 bp, synthetic construct
  source 1..18: mol_type = other DNA
taatacgtcacacaaatg

SEQ ID NO: 68528 - DNA, 18 bp, synthetic construct
  source 1..18: mol_type = other DNA
taatacgtcgttttgtag

SEQ ID NO: 68529 - DNA, 18 bp, synthetic construct
  source 1..18: mol_type = other DNA
taatacgtgcaaatattg

SEQ ID NO: 68530 - DNA, 18 bp, synthetic construct
  source 1..18: mol_type = other DNA
taatacgttttagtattg

SEQ ID NO: 68531 - DNA, 18 bp, synthetic construct
  source 1..18: mol_type = other DNA
taatactaaacacaagag

SEQ ID NO: 68532 - DNA, 18 bp, synthetic construct
  source 1..18: mol_type = other DNA
taatactacaaagtaatg

SEQ ID NO: 68533 - DNA, 18 bp, synthetic construct
  source 1..18: mol_type = other DNA
taatactacatactcaag

SEQ ID NO: 68534 - DNA, 18 bp, synthetic construct
  source 1..18: mol_type = other DNA
taatactacgcacagttg

SEQ ID NO: 68535 - DNA, 18 bp, synthetic construct
  source 1..18: mol_type = other DNA
taatactacgcactccgg

SEQ ID NO: 68536 - DNA, 18 bp, synthetic construct
  source 1..18: mol_type = other DNA
taatactactcaggtaag

SEQ ID NO: 68537 - DNA, 18 bp, synthetic construct
  source 1..18: mol_type = other DNA
taatactatagattatag

SEQ ID NO: 68538 - DNA, 18 bp, synthetic construct
  source 1..18: mol_type = other DNA
taatactatgttcctgag

SEQ ID NO: 68539 - DNA, 18 bp, synthetic construct
  source 1..18: mol_type = other DNA
taatactcttcattttag

SEQ ID NO: 68540 - DNA, 18 bp, synthetic construct
  source 1..18: mol_type = other DNA
taatactgcaaacctcag

SEQ ID NO: 68541 - DNA, 18 bp, synthetic construct
  source 1..18: mol_type = other DNA
taatactgctcccactag

SEQ ID NO: 68542 - DNA, 18 bp, synthetic construct
  source 1..18: mol_type = other DNA
taatacttaactctatag

SEQ ID NO: 68543 - DNA, 18 bp, synthetic construct
  source 1..18: mol_type = other DNA
taatacttatccccatag

SEQ ID NO: 68544 - DNA, 18 bp, synthetic construct
  source 1..18: mol_type = other DNA
taatacttatgattaatg

SEQ ID NO: 68545 - DNA, 18 bp, synthetic construct
  source 1..18: mol_type = other DNA
taatacttcaaagtatag

SEQ ID NO: 68546 - DNA, 18 bp, synthetic construct
  source 1..18: mol_type = other DNA
taatacttgacactaatg

SEQ ID NO: 68547 - DNA, 18 bp, synthetic construct
  source 1..18: mol_type = other DNA
taatacttgtcacttaag

SEQ ID NO: 68548 - DNA, 18 bp, synthetic construct
  source 1..18: mol_type = other DNA
taatagcactcatttatg

SEQ ID NO: 68549 - DNA, 18 bp, synthetic construct
  source 1..18: mol_type = other DNA
taataggaaatagtatag

SEQ ID NO: 68550 - DNA, 18 bp, synthetic construct
  source 1..18: mol_type = other DNA
taatagggcacacattag

SEQ ID NO: 68551 - DNA, 18 bp, synthetic construct
  source 1..18: mol_type = other DNA
taataggtataattatcg

SEQ ID NO: 68552 - DNA, 18 bp, synthetic construct
  source 1..18: mol_type = other DNA
taataggtgtcaataaag

SEQ ID NO: 68553 - DNA, 18 bp, synthetic construct
  source 1..18: mol_type = other DNA
taatagttatgaaaatag

SEQ ID NO: 68554 - DNA, 18 bp, synthetic construct
  source 1..18: mol_type = other DNA
taatataatacataaatg

SEQ ID NO: 68555 - DNA, 18 bp, synthetic construct
  source 1..18: mol_type = other DNA
taatatcactctcttgcg

SEQ ID NO: 68556 - DNA, 18 bp, synthetic construct
  source 1..18: mol_type = other DNA
taatatcagactctatag

SEQ ID NO: 68557 - DNA, 18 bp, synthetic construct
  source 1..18: mol_type = other DNA
taatatctctcatcatag

SEQ ID NO: 68558 - DNA, 18 bp, synthetic construct
  source 1..18: mol_type = other DNA
taatatgacacaatccag

SEQ ID NO: 68559 - DNA, 18 bp, synthetic construct
  source 1..18: mol_type = other DNA
taatatgagtcatagtag

SEQ ID NO: 68560 - DNA, 18 bp, synthetic construct
  source 1..18: mol_type = other DNA
taatatgattaactaatg

SEQ ID NO: 68561 - DNA, 18 bp, synthetic construct
  source 1..18: mol_type = other DNA
taatatgtttgaatatcg

SEQ ID NO: 68562 - DNA, 18 bp, synthetic construct
  source 1..18: mol_type = other DNA
taatatgttttaataaag

SEQ ID NO: 68563 - DNA, 18 bp, synthetic construct
  source 1..18: mol_type = other DNA
taatattaaaaactatag

SEQ ID NO: 68564 - DNA, 18 bp, synthetic construct
  source 1..18: mol_type = other DNA
taatattacacgctatcg

SEQ ID NO: 68565 - DNA, 18 bp, synthetic construct
  source 1..18: mol_type = other DNA
taatattacacttcatag

SEQ ID NO: 68566 - DNA, 18 bp, synthetic construct
  source 1..18: mol_type = other DNA
taatcagaaacactgtag

SEQ ID NO: 68567 - DNA, 18 bp, synthetic construct
  source 1..18: mol_type = other DNA
taatcagtctcattagag

SEQ ID NO: 68568 - DNA, 18 bp, synthetic construct
  source 1..18: mol_type = other DNA
taatccaacgccctaaag

SEQ ID NO: 68569 - DNA, 18 bp, synthetic construct
  source 1..18: mol_type = other DNA
taatccgactcccattgg

SEQ ID NO: 68570 - DNA, 18 bp, synthetic construct
  source 1..18: mol_type = other DNA
taatccgactcgtaggcg

SEQ ID NO: 68571 - DNA, 18 bp, synthetic construct
  source 1..18: mol_type = other DNA
taatccgacttacctatg

SEQ ID NO: 68572 - DNA, 18 bp, synthetic construct
  source 1..18: mol_type = other DNA
taatccgattcaaaaaag

SEQ ID NO: 68573 - DNA, 18 bp, synthetic construct
  source 1..18: mol_type = other DNA
taatccgccacactaacg

SEQ ID NO: 68574 - DNA, 18 bp, synthetic construct
  source 1..18: mol_type = other DNA
taatccggctccgtatcg

SEQ ID NO: 68575 - DNA, 18 bp, synthetic construct
  source 1..18: mol_type = other DNA
taatccgtaacatcatag

SEQ ID NO: 68576 - DNA, 18 bp, synthetic construct
  source 1..18: mol_type = other DNA
taatccgtcgctccatag

SEQ ID NO: 68577 - DNA, 18 bp, synthetic construct
  source 1..18: mol_type = other DNA
taatccgtgtcactcatg

SEQ ID NO: 68578 - DNA, 18 bp, synthetic construct
  source 1..18: mol_type = other DNA
taatcctactgaacatag

SEQ ID NO: 68579 - DNA, 18 bp, synthetic construct
  source 1..18: mol_type = other DNA
taatcctattcattattg

SEQ ID NO: 68580 - DNA, 18 bp, synthetic construct
  source 1..18: mol_type = other DNA
taatccttctctctatgg

SEQ ID NO: 68581 - DNA, 18 bp, synthetic construct
  source 1..18: mol_type = other DNA
taatgaagttcgctattg

SEQ ID NO: 68582 - DNA, 18 bp, synthetic construct
  source 1..18: mol_type = other DNA
taatgatcttctctgtag

SEQ ID NO: 68583 - DNA, 18 bp, synthetic construct
  source 1..18: mol_type = other DNA
taatgcaactcaattaag

SEQ ID NO: 68584 - DNA, 18 bp, synthetic construct
  source 1..18: mol_type = other DNA
taatgcatcttactttag

SEQ ID NO: 68585 - DNA, 18 bp, synthetic construct
  source 1..18: mol_type = other DNA
taatgcgacttgctcgag

SEQ ID NO: 68586 - DNA, 18 bp, synthetic construct
  source 1..18: mol_type = other DNA
taatgcgagtctatattg

SEQ ID NO: 68587 - DNA, 18 bp, synthetic construct
  source 1..18: mol_type = other DNA
taatgcgcatctctaaag

SEQ ID NO: 68588 - DNA, 18 bp, synthetic construct
  source 1..18: mol_type = other DNA
taatgcggatggagatag

SEQ ID NO: 68589 - DNA, 18 bp, synthetic construct
  source 1..18: mol_type = other DNA
taatgcgtaacgctgttg

SEQ ID NO: 68590 - DNA, 18 bp, synthetic construct
  source 1..18: mol_type = other DNA
taatgcgtcactttatag

SEQ ID NO: 68591 - DNA, 18 bp, synthetic construct
  source 1..18: mol_type = other DNA
taatgcgtcatcctacag

SEQ ID NO: 68592 - DNA, 18 bp, synthetic construct
  source 1..18: mol_type = other DNA
taatgcgtctctctgttg

SEQ ID NO: 68593 - DNA, 18 bp, synthetic construct
  source 1..18: mol_type = other DNA
taatgctacacacaattg

SEQ ID NO: 68594 - DNA, 18 bp, synthetic construct
  source 1..18: mol_type = other DNA
taatgctactgacttaag

SEQ ID NO: 68595 - DNA, 18 bp, synthetic construct
  source 1..18: mol_type = other DNA
taatgctgatcacttaag

SEQ ID NO: 68596 - DNA, 18 bp, synthetic construct
  source 1..18: mol_type = other DNA
taatgtcactcctaatag

SEQ ID NO: 68597 - DNA, 18 bp, synthetic construct
  source 1..18: mol_type = other DNA
taatgtgaatcacaaatg

SEQ ID NO: 68598 - DNA, 18 bp, synthetic construct
  source 1..18: mol_type = other DNA
taatgtggctcaccaaag

SEQ ID NO: 68599 - DNA, 18 bp, synthetic construct
  source 1..18: mol_type = other DNA
taatgtggctcaccgtag

SEQ ID NO: 68600 - DNA, 18 bp, synthetic construct
  source 1..18: mol_type = other DNA
taattaaatctacttaag

SEQ ID NO: 68601 - DNA, 18 bp, synthetic construct
  source 1..18: mol_type = other DNA
taattagcctctctattg

SEQ ID NO: 68602 - DNA, 18 bp, synthetic construct
  source 1..18: mol_type = other DNA
taattagtctcagtttag

SEQ ID NO: 68603 - DNA, 18 bp, synthetic construct
  source 1..18: mol_type = other DNA
taattatataacctatag

SEQ ID NO: 68604 - DNA, 18 bp, synthetic construct
  source 1..18: mol_type = other DNA
taattcaactcagttttg

SEQ ID NO: 68605 - DNA, 18 bp, synthetic construct
  source 1..18: mol_type = other DNA
taattccattcacaaaag

SEQ ID NO: 68606 - DNA, 18 bp, synthetic construct
  source 1..18: mol_type = other DNA
taattccattctcaatag

SEQ ID NO: 68607 - DNA, 18 bp, synthetic construct
  source 1..18: mol_type = other DNA
taattcctctctctatgg

SEQ ID NO: 68608 - DNA, 18 bp, synthetic construct
  source 1..18: mol_type = other DNA
taattcgaatcataattg

SEQ ID NO: 68609 - DNA, 18 bp, synthetic construct
  source 1..18: mol_type = other DNA
taattcgacacgccaaag

SEQ ID NO: 68610 - DNA, 18 bp, synthetic construct
  source 1..18: mol_type = other DNA
taattcgacgcatcatcg

SEQ ID NO: 68611 - DNA, 18 bp, synthetic construct
  source 1..18: mol_type = other DNA
taattcgactcacacaaa

SEQ ID NO: 68612 - DNA, 18 bp, synthetic construct
  source 1..18: mol_type = other DNA
taattcgatattctatag

SEQ ID NO: 68613 - DNA, 18 bp, synthetic construct
  source 1..18: mol_type = other DNA
taattcgcctgtcgaatg

SEQ ID NO: 68614 - DNA, 18 bp, synthetic construct
  source 1..18: mol_type = other DNA
taattcggtttcctattg

SEQ ID NO: 68615 - DNA, 18 bp, synthetic construct
  source 1..18: mol_type = other DNA
taattcgtatcattaggg

SEQ ID NO: 68616 - DNA, 18 bp, synthetic construct
  source 1..18: mol_type = other DNA
taattcgtatgacaatag

SEQ ID NO: 68617 - DNA, 18 bp, synthetic construct
  source 1..18: mol_type = other DNA
taattcgtccaaatatag

SEQ ID NO: 68618 - DNA, 18 bp, synthetic construct
  source 1..18: mol_type = other DNA
taattcgtcgttctcatg

SEQ ID NO: 68619 - DNA, 18 bp, synthetic construct
  source 1..18: mol_type = other DNA
taattcgtctcacttacg

SEQ ID NO: 68620 - DNA, 18 bp, synthetic construct
  source 1..18: mol_type = other DNA
taattcgtcttactttcg

SEQ ID NO: 68621 - DNA, 18 bp, synthetic construct
  source 1..18: mol_type = other DNA
taattcgttacactacag

SEQ ID NO: 68622 - DNA, 18 bp, synthetic construct
  source 1..18: mol_type = other DNA
taattctactgacaaaag

SEQ ID NO: 68623 - DNA, 18 bp, synthetic construct
  source 1..18: mol_type = other DNA
taattctattaaccatag

SEQ ID NO: 68624 - DNA, 18 bp, synthetic construct
  source 1..18: mol_type = other DNA
taattctgctcataatag

SEQ ID NO: 68625 - DNA, 18 bp, synthetic construct
  source 1..18: mol_type = other DNA
taattgaagtccttatcg

SEQ ID NO: 68626 - DNA, 18 bp, synthetic construct
  source 1..18: mol_type = other DNA
taattgggcaacctttag

SEQ ID NO: 68627 - DNA, 18 bp, synthetic construct
  source 1..18: mol_type = other DNA
taattggtcacattgttg

SEQ ID NO: 68628 - DNA, 18 bp, synthetic construct
  source 1..18: mol_type = other DNA
taattgttcacactatag

SEQ ID NO: 68629 - DNA, 18 bp, synthetic construct
  source 1..18: mol_type = other DNA
taatttgacactcttttg

SEQ ID NO: 68630 - DNA, 18 bp, synthetic construct
  source 1..18: mol_type = other DNA
taatttgacagtctatag

SEQ ID NO: 68631 - DNA, 18 bp, synthetic construct
  source 1..18: mol_type = other DNA
taatttgtctcaatatcg

SEQ ID NO: 68632 - DNA, 18 bp, synthetic construct
  source 1..18: mol_type = other DNA
tacaaagtctcacaatag

SEQ ID NO: 68633 - DNA, 18 bp, synthetic construct
  source 1..18: mol_type = other DNA
tacaacaactcacttgag

SEQ ID NO: 68634 - DNA, 18 bp, synthetic construct
  source 1..18: mol_type = other DNA
tacaacgactcactcggg

SEQ ID NO: 68635 - DNA, 18 bp, synthetic construct
  source 1..18: mol_type = other DNA
tacactaattcacacaag

SEQ ID NO: 68636 - DNA, 18 bp, synthetic construct
  source 1..18: mol_type = other DNA
tacacttactccttatag

SEQ ID NO: 68637 - DNA, 18 bp, synthetic construct
  source 1..18: mol_type = other DNA
tacagcacctcaccgttg

SEQ ID NO: 68638 - DNA, 18 bp, synthetic construct
  source 1..18: mol_type = other DNA
tacatccactctctttag

SEQ ID NO: 68639 - DNA, 18 bp, synthetic construct
  source 1..18: mol_type = other DNA
tacatcgaatcacttttg

SEQ ID NO: 68640 - DNA, 18 bp, synthetic construct
  source 1..18: mol_type = other DNA
tacatcgtatcactatag

SEQ ID NO: 68641 - DNA, 18 bp, synthetic construct
  source 1..18: mol_type = other DNA
taccacgacccagtctag

SEQ ID NO: 68642 - DNA, 18 bp, synthetic construct
  source 1..18: mol_type = other DNA
taccacgactctattttg

SEQ ID NO: 68643 - DNA, 18 bp, synthetic construct
  source 1..18: mol_type = other DNA
taccccgagttactctag

SEQ ID NO: 68644 - DNA, 18 bp, synthetic construct
  source 1..18: mol_type = other DNA
tacctagcttaactaaag

SEQ ID NO: 68645 - DNA, 18 bp, synthetic construct
  source 1..18: mol_type = other DNA
tacctcgacgtactctcg

SEQ ID NO: 68646 - DNA, 18 bp, synthetic construct
  source 1..18: mol_type = other DNA
tacgccgtctcacaatag

SEQ ID NO: 68647 - DNA, 18 bp, synthetic construct
  source 1..18: mol_type = other DNA
tacgtggactctctttag

SEQ ID NO: 68648 - DNA, 18 bp, synthetic construct
  source 1..18: mol_type = other DNA
tactacaactcttgtttg

SEQ ID NO: 68649 - DNA, 18 bp, synthetic construct
  source 1..18: mol_type = other DNA
tactacaacttatttatg

SEQ ID NO: 68650 - DNA, 18 bp, synthetic construct
  source 1..18: mol_type = other DNA
tactaccaagcactaaag

SEQ ID NO: 68651 - DNA, 18 bp, synthetic construct
  source 1..18: mol_type = other DNA
tactaccacttattacag

SEQ ID NO: 68652 - DNA, 18 bp, synthetic construct
  source 1..18: mol_type = other DNA
tactacgaatcacatttg

SEQ ID NO: 68653 - DNA, 18 bp, synthetic construct
  source 1..18: mol_type = other DNA
tactacgcgtctcaatag

SEQ ID NO: 68654 - DNA, 18 bp, synthetic construct
  source 1..18: mol_type = other DNA
tactactactcatttatg

SEQ ID NO: 68655 - DNA, 18 bp, synthetic construct
  source 1..18: mol_type = other DNA
tactacttttatgtccag

SEQ ID NO: 68656 - DNA, 18 bp, synthetic construct
  source 1..18: mol_type = other DNA
tactataactttttatag

SEQ ID NO: 68657 - DNA, 18 bp, synthetic construct
  source 1..18: mol_type = other DNA
tactatgactcacaaatg

SEQ ID NO: 68658 - DNA, 18 bp, synthetic construct
  source 1..18: mol_type = other DNA
tactatgacttcttatag

SEQ ID NO: 68659 - DNA, 18 bp, synthetic construct
  source 1..18: mol_type = other DNA
tactccgacagcctatag

SEQ ID NO: 68660 - DNA, 18 bp, synthetic construct
  source 1..18: mol_type = other DNA
tactgcgacacacgttac

SEQ ID NO: 68661 - DNA, 18 bp, synthetic construct
  source 1..18: mol_type = other DNA
tactgtgacttagtatag

SEQ ID NO: 68662 - DNA, 18 bp, synthetic construct
  source 1..18: mol_type = other DNA
tacttcaactctctgaag

SEQ ID NO: 68663 - DNA, 18 bp, synthetic construct
  source 1..18: mol_type = other DNA
tacttcgactctctgatg

SEQ ID NO: 68664 - DNA, 18 bp, synthetic construct
  source 1..18: mol_type = other DNA
tacttcggctcactaatg

SEQ ID NO: 68665 - DNA, 18 bp, synthetic construct
  source 1..18: mol_type = other DNA
tacttcgtctaacttcag

SEQ ID NO: 68666 - DNA, 18 bp, synthetic construct
  source 1..18: mol_type = other DNA
tacttcgtctctctattg

SEQ ID NO: 68667 - DNA, 18 bp, synthetic construct
  source 1..18: mol_type = other DNA
tacttctactctaaatag

SEQ ID NO: 68668 - DNA, 18 bp, synthetic construct
  source 1..18: mol_type = other DNA
tactttgacttacaatag

SEQ ID NO: 68669 - DNA, 18 bp, synthetic construct
  source 1..18: mol_type = other DNA
tagaaacttttactaaag

SEQ ID NO: 68670 - DNA, 18 bp, synthetic construct
  source 1..18: mol_type = other DNA
tagaacgtcacattaaag

SEQ ID NO: 68671 - DNA, 18 bp, synthetic construct
  source 1..18: mol_type = other DNA
tagaactaaacacttatg

SEQ ID NO: 68672 - DNA, 18 bp, synthetic construct
  source 1..18: mol_type = other DNA
tagaccgactctctatgg

SEQ ID NO: 68673 - DNA, 18 bp, synthetic construct
  source 1..18: mol_type = other DNA
tagagcgaatctatctgg

SEQ ID NO: 68674 - DNA, 18 bp, synthetic construct
  source 1..18: mol_type = other DNA
tagatggacttactttag

SEQ ID NO: 68675 - DNA, 18 bp, synthetic construct
  source 1..18: mol_type = other DNA
tagattgactcccttaag

SEQ ID NO: 68676 - DNA, 18 bp, synthetic construct
  source 1..18: mol_type = other DNA
tagtaagactctagatag

SEQ ID NO: 68677 - DNA, 18 bp, synthetic construct
  source 1..18: mol_type = other DNA
tagtacaactctcgttag

SEQ ID NO: 68678 - DNA, 18 bp, synthetic construct
  source 1..18: mol_type = other DNA
tagtacgacctagtttcg

SEQ ID NO: 68679 - DNA, 18 bp, synthetic construct
  source 1..18: mol_type = other DNA
tagtacgactatcactag

SEQ ID NO: 68680 - DNA, 18 bp, synthetic construct
  source 1..18: mol_type = other DNA
tagtacgactttatttag

SEQ ID NO: 68681 - DNA, 18 bp, synthetic construct
  source 1..18: mol_type = other DNA
tagtacgtagctctatag

SEQ ID NO: 68682 - DNA, 18 bp, synthetic construct
  source 1..18: mol_type = other DNA
tagtacgtctgactcatg

SEQ ID NO: 68683 - DNA, 18 bp, synthetic construct
  source 1..18: mol_type = other DNA
tagtacgtgtaactattg

SEQ ID NO: 68684 - DNA, 18 bp, synthetic construct
  source 1..18: mol_type = other DNA
tagtactactcaataatg

SEQ ID NO: 68685 - DNA, 18 bp, synthetic construct
  source 1..18: mol_type = other DNA
tagtactactctccttag

SEQ ID NO: 68686 - DNA, 18 bp, synthetic construct
  source 1..18: mol_type = other DNA
tagtactattcacagtag

SEQ ID NO: 68687 - DNA, 18 bp, synthetic construct
  source 1..18: mol_type = other DNA
tagtccgacacgtaattg

SEQ ID NO: 68688 - DNA, 18 bp, synthetic construct
  source 1..18: mol_type = other DNA
tagtccgacatactattg

SEQ ID NO: 68689 - DNA, 18 bp, synthetic construct
  source 1..18: mol_type = other DNA
tagtccgagtcaccagag

SEQ ID NO: 68690 - DNA, 18 bp, synthetic construct
  source 1..18: mol_type = other DNA
tagtgcttctcacaaaag

SEQ ID NO: 68691 - DNA, 18 bp, synthetic construct
  source 1..18: mol_type = other DNA
tagttatacacgctatag

SEQ ID NO: 68692 - DNA, 18 bp, synthetic construct
  source 1..18: mol_type = other DNA
tagttcaactcgctacag

SEQ ID NO: 68693 - DNA, 18 bp, synthetic construct
  source 1..18: mol_type = other DNA
tagttcgactccatatcg

SEQ ID NO: 68694 - DNA, 18 bp, synthetic construct
  source 1..18: mol_type = other DNA
tagttcgccacattaaag

SEQ ID NO: 68695 - DNA, 18 bp, synthetic construct
  source 1..18: mol_type = other DNA
tagttcgtatcaatatag

SEQ ID NO: 68696 - DNA, 18 bp, synthetic construct
  source 1..18: mol_type = other DNA
tagttcgtcagactatag

SEQ ID NO: 68697 - DNA, 18 bp, synthetic construct
  source 1..18: mol_type = other DNA
tagtttgtctgactatag

SEQ ID NO: 68698 - DNA, 18 bp, synthetic construct
  source 1..18: mol_type = other DNA
tataacaacacaatattg

SEQ ID NO: 68699 - DNA, 18 bp, synthetic construct
  source 1..18: mol_type = other DNA
tataaccactcactcaag

SEQ ID NO: 68700 - DNA, 18 bp, synthetic construct
  source 1..18: mol_type = other DNA
tataaccactctcaaagg

SEQ ID NO: 68701 - DNA, 18 bp, synthetic construct
  source 1..18: mol_type = other DNA
tataaccacttagcatag

SEQ ID NO: 68702 - DNA, 18 bp, synthetic construct
  source 1..18: mol_type = other DNA
tataacgaatctatatag

SEQ ID NO: 68703 - DNA, 18 bp, synthetic construct
  source 1..18: mol_type = other DNA
tataacgactaactaatg

SEQ ID NO: 68704 - DNA, 18 bp, synthetic construct
  source 1..18: mol_type = other DNA
tataacgactatcaatag

SEQ ID NO: 68705 - DNA, 18 bp, synthetic construct
  source 1..18: mol_type = other DNA
tataacgactctcagtag

SEQ ID NO: 68706 - DNA, 18 bp, synthetic construct
  source 1..18: mol_type = other DNA
tataacgattcactcaag

SEQ ID NO: 68707 - DNA, 18 bp, synthetic construct
  source 1..18: mol_type = other DNA
tataacgccacagattgg

SEQ ID NO: 68708 - DNA, 18 bp, synthetic construct
  source 1..18: mol_type = other DNA
tataacgcctcactaatg

SEQ ID NO: 68709 - DNA, 18 bp, synthetic construct
  source 1..18: mol_type = other DNA
tataacgtcgtactcatg

SEQ ID NO: 68710 - DNA, 18 bp, synthetic construct
  source 1..18: mol_type = other DNA
tataactactaactcgag

SEQ ID NO: 68711 - DNA, 18 bp, synthetic construct
  source 1..18: mol_type = other DNA
tataactccacacaatag

SEQ ID NO: 68712 - DNA, 18 bp, synthetic construct
  source 1..18: mol_type = other DNA
tataacttctcattatag

SEQ ID NO: 68713 - DNA, 18 bp, synthetic construct
  source 1..18: mol_type = other DNA
tataaggtctctctctag

SEQ ID NO: 68714 - DNA, 18 bp, synthetic construct
  source 1..18: mol_type = other DNA
tatataaacgcactaaag

SEQ ID NO: 68715 - DNA, 18 bp, synthetic construct
  source 1..18: mol_type = other DNA
tatatctacacattaacg

SEQ ID NO: 68716 - DNA, 18 bp, synthetic construct
  source 1..18: mol_type = other DNA
tatcaagacttattatag

SEQ ID NO: 68717 - DNA, 18 bp, synthetic construct
  source 1..18: mol_type = other DNA
tatcacaaaacacgatcg

SEQ ID NO: 68718 - DNA, 18 bp, synthetic construct
  source 1..18: mol_type = other DNA
tatcaccattgactcaag

SEQ ID NO: 68719 - DNA, 18 bp, synthetic construct
  source 1..18: mol_type = other DNA
tatcacgactttttatag

SEQ ID NO: 68720 - DNA, 18 bp, synthetic construct
  source 1..18: mol_type = other DNA
tatcacgtttcactctag

SEQ ID NO: 68721 - DNA, 18 bp, synthetic construct
  source 1..18: mol_type = other DNA
tatcgttattatctatag

SEQ ID NO: 68722 - DNA, 18 bp, synthetic construct
  source 1..18: mol_type = other DNA
tatctcgattctccatag

SEQ ID NO: 68723 - DNA, 18 bp, synthetic construct
  source 1..18: mol_type = other DNA
tatctctaatcacaattg

SEQ ID NO: 68724 - DNA, 18 bp, synthetic construct
  source 1..18: mol_type = other DNA
tatctggccacacaatag

SEQ ID NO: 68725 - DNA, 18 bp, synthetic construct
  source 1..18: mol_type = other DNA
tatgaagcatatgtatag

SEQ ID NO: 68726 - DNA, 18 bp, synthetic construct
  source 1..18: mol_type = other DNA
tatgacgtctcactcaag

SEQ ID NO: 68727 - DNA, 18 bp, synthetic construct
  source 1..18: mol_type = other DNA
tatgagtcctcactaaag

SEQ ID NO: 68728 - DNA, 18 bp, synthetic construct
  source 1..18: mol_type = other DNA
tatgccatcactctaaag

SEQ ID NO: 68729 - DNA, 18 bp, synthetic construct
  source 1..18: mol_type = other DNA
tattaaaacccattatag

SEQ ID NO: 68730 - DNA, 18 bp, synthetic construct
  source 1..18: mol_type = other DNA
tattaaccgtctctttag

SEQ ID NO: 68731 - DNA, 18 bp, synthetic construct
  source 1..18: mol_type = other DNA
tattaagacaatcaaaag

SEQ ID NO: 68732 - DNA, 18 bp, synthetic construct
  source 1..18: mol_type = other DNA
tattacaacacacattag

SEQ ID NO: 68733 - DNA, 18 bp, synthetic construct
  source 1..18: mol_type = other DNA
tattacaacgttctatag

SEQ ID NO: 68734 - DNA, 18 bp, synthetic construct
  source 1..18: mol_type = other DNA
tattacaactaaatttag

SEQ ID NO: 68735 - DNA, 18 bp, synthetic construct
  source 1..18: mol_type = other DNA
tattacaactatcgaaag

SEQ ID NO: 68736 - DNA, 18 bp, synthetic construct
  source 1..18: mol_type = other DNA
tattacaattctctattg

SEQ ID NO: 68737 - DNA, 18 bp, synthetic construct
  source 1..18: mol_type = other DNA
tattaccactcaaaatcg

SEQ ID NO: 68738 - DNA, 18 bp, synthetic construct
  source 1..18: mol_type = other DNA
tattacgaataattaccg

SEQ ID NO: 68739 - DNA, 18 bp, synthetic construct
  source 1..18: mol_type = other DNA
tattacgacacaatagcg

SEQ ID NO: 68740 - DNA, 18 bp, synthetic construct
  source 1..18: mol_type = other DNA
tattacgacacatcttag

SEQ ID NO: 68741 - DNA, 18 bp, synthetic construct
  source 1..18: mol_type = other DNA
tattacgacatgctttag

SEQ ID NO: 68742 - DNA, 18 bp, synthetic construct
  source 1..18: mol_type = other DNA
tattacgaccctacatag

SEQ ID NO: 68743 - DNA, 18 bp, synthetic construct
  source 1..18: mol_type = other DNA
tattacgactcgctcatg

SEQ ID NO: 68744 - DNA, 18 bp, synthetic construct
  source 1..18: mol_type = other DNA
tattacgactcgcttctg

SEQ ID NO: 68745 - DNA, 18 bp, synthetic construct
  source 1..18: mol_type = other DNA
tattacgattctaaatag

SEQ ID NO: 68746 - DNA, 18 bp, synthetic construct
  source 1..18: mol_type = other DNA
tattacgcctagctttag

SEQ ID NO: 68747 - DNA, 18 bp, synthetic construct
  source 1..18: mol_type = other DNA
tattacgcctattaatcg

SEQ ID NO: 68748 - DNA, 18 bp, synthetic construct
  source 1..18: mol_type = other DNA
tattacgcttcaccgtag

SEQ ID NO: 68749 - DNA, 18 bp, synthetic construct
  source 1..18: mol_type = other DNA
tattacgtatctgcatag

SEQ ID NO: 68750 - DNA, 18 bp, synthetic construct
  source 1..18: mol_type = other DNA
tattacgtctaacaccag

SEQ ID NO: 68751 - DNA, 18 bp, synthetic construct
  source 1..18: mol_type = other DNA
tattacgtctcattgttg

SEQ ID NO: 68752 - DNA, 18 bp, synthetic construct
  source 1..18: mol_type = other DNA
tattacgttatcctttag

SEQ ID NO: 68753 - DNA, 18 bp, synthetic construct
  source 1..18: mol_type = other DNA
tattacgtttcaatattg

SEQ ID NO: 68754 - DNA, 18 bp, synthetic construct
  source 1..18: mol_type = other DNA
tattacgttttattatag

SEQ ID NO: 68755 - DNA, 18 bp, synthetic construct
  source 1..18: mol_type = other DNA
tattactaaacactagag

SEQ ID NO: 68756 - DNA, 18 bp, synthetic construct
  source 1..18: mol_type = other DNA
tattactaatctctttag

SEQ ID NO: 68757 - DNA, 18 bp, synthetic construct
  source 1..18: mol_type = other DNA
tattactaattacaatag

SEQ ID NO: 68758 - DNA, 18 bp, synthetic construct
  source 1..18: mol_type = other DNA
tattactacatattatag

SEQ ID NO: 68759 - DNA, 18 bp, synthetic construct
  source 1..18: mol_type = other DNA
tattactaccatcgattg

SEQ ID NO: 68760 - DNA, 18 bp, synthetic construct
  source 1..18: mol_type = other DNA
tattactactgtctattg

SEQ ID NO: 68761 - DNA, 18 bp, synthetic construct
  source 1..18: mol_type = other DNA
tattactcctcactcaag

SEQ ID NO: 68762 - DNA, 18 bp, synthetic construct
  source 1..18: mol_type = other DNA
tattactcttcacttttg

SEQ ID NO: 68763 - DNA, 18 bp, synthetic construct
  source 1..18: mol_type = other DNA
tattactgctctctttag

SEQ ID NO: 68764 - DNA, 18 bp, synthetic construct
  source 1..18: mol_type = other DNA
tattacttatcactatgg

SEQ ID NO: 68765 - DNA, 18 bp, synthetic construct
  source 1..18: mol_type = other DNA
tattacttcccacaatgg

SEQ ID NO: 68766 - DNA, 18 bp, synthetic construct
  source 1..18: mol_type = other DNA
tattacttctcacagttg

SEQ ID NO: 68767 - DNA, 18 bp, synthetic construct
  source 1..18: mol_type = other DNA
tattacttctcactcttg

SEQ ID NO: 68768 - DNA, 18 bp, synthetic construct
  source 1..18: mol_type = other DNA
tattaggactcatattag

SEQ ID NO: 68769 - DNA, 18 bp, synthetic construct
  source 1..18: mol_type = other DNA
tattaggactcatttttg

SEQ ID NO: 68770 - DNA, 18 bp, synthetic construct
  source 1..18: mol_type = other DNA
tattaggactttctattg

SEQ ID NO: 68771 - DNA, 18 bp, synthetic construct
  source 1..18: mol_type = other DNA
tattaggatacactaatg

SEQ ID NO: 68772 - DNA, 18 bp, synthetic construct
  source 1..18: mol_type = other DNA
tattatcactcacaaaag

SEQ ID NO: 68773 - DNA, 18 bp, synthetic construct
  source 1..18: mol_type = other DNA
tattatgaatcacattag

SEQ ID NO: 68774 - DNA, 18 bp, synthetic construct
  source 1..18: mol_type = other DNA
tattatgactcgcataag

SEQ ID NO: 68775 - DNA, 18 bp, synthetic construct
  source 1..18: mol_type = other DNA
tattatgatccgcattag

SEQ ID NO: 68776 - DNA, 18 bp, synthetic construct
  source 1..18: mol_type = other DNA
tattatgcatctctatag

SEQ ID NO: 68777 - DNA, 18 bp, synthetic construct
  source 1..18: mol_type = other DNA
tattatgtttctctatag

SEQ ID NO: 68778 - DNA, 18 bp, synthetic construct
  source 1..18: mol_type = other DNA
tattatttaacattatag

SEQ ID NO: 68779 - DNA, 18 bp, synthetic construct
  source 1..18: mol_type = other DNA
tattccgacgcaaggtcg

SEQ ID NO: 68780 - DNA, 18 bp, synthetic construct
  source 1..18: mol_type = other DNA
tattcggactgcctatag

SEQ ID NO: 68781 - DNA, 18 bp, synthetic construct
  source 1..18: mol_type = other DNA
tattgagtctcactaaag

SEQ ID NO: 68782 - DNA, 18 bp, synthetic construct
  source 1..18: mol_type = other DNA
tattgccactcgttactg

SEQ ID NO: 68783 - DNA, 18 bp, synthetic construct
  source 1..18: mol_type = other DNA
tattgcgactcagtcaag

SEQ ID NO: 68784 - DNA, 18 bp, synthetic construct
  source 1..18: mol_type = other DNA
tattgcgtttcactctag

SEQ ID NO: 68785 - DNA, 18 bp, synthetic construct
  source 1..18: mol_type = other DNA
tattgctaatcattactg

SEQ ID NO: 68786 - DNA, 18 bp, synthetic construct
  source 1..18: mol_type = other DNA
tattgctactcattttag

SEQ ID NO: 68787 - DNA, 18 bp, synthetic construct
  source 1..18: mol_type = other DNA
tattgctacttacaacag

SEQ ID NO: 68788 - DNA, 18 bp, synthetic construct
  source 1..18: mol_type = other DNA
tatttacaataactatag

SEQ ID NO: 68789 - DNA, 18 bp, synthetic construct
  source 1..18: mol_type = other DNA
tatttagtctcacttctg

SEQ ID NO: 68790 - DNA, 18 bp, synthetic construct
  source 1..18: mol_type = other DNA
tatttcaattcactttag

SEQ ID NO: 68791 - DNA, 18 bp, synthetic construct
  source 1..18: mol_type = other DNA
tatttccactctgaattg

SEQ ID NO: 68792 - DNA, 18 bp, synthetic construct
  source 1..18: mol_type = other DNA
tatttcgactcacacttg

SEQ ID NO: 68793 - DNA, 18 bp, synthetic construct
  source 1..18: mol_type = other DNA
tatttcgacttaccaaag

SEQ ID NO: 68794 - DNA, 18 bp, synthetic construct
  source 1..18: mol_type = other DNA
tatttcgacttacttttg

SEQ ID NO: 68795 - DNA, 18 bp, synthetic construct
  source 1..18: mol_type = other DNA
tatttcgcctcacattag

SEQ ID NO: 68796 - DNA, 18 bp, synthetic construct
  source 1..18: mol_type = other DNA
tatttcgccttgctattg

SEQ ID NO: 68797 - DNA, 18 bp, synthetic construct
  source 1..18: mol_type = other DNA
tatttcgtctagctattg

SEQ ID NO: 68798 - DNA, 18 bp, synthetic construct
  source 1..18: mol_type = other DNA
tatttcgtcttacacaag

SEQ ID NO: 68799 - DNA, 18 bp, synthetic construct
  source 1..18: mol_type = other DNA
tatttctactcactaatg

SEQ ID NO: 68800 - DNA, 18 bp, synthetic construct
  source 1..18: mol_type = other DNA
tatttcttcactctatag

SEQ ID NO: 68801 - DNA, 18 bp, synthetic construct
  source 1..18: mol_type = other DNA
tatttgcacccactattg

SEQ ID NO: 68802 - DNA, 18 bp, synthetic construct
  source 1..18: mol_type = other DNA
tatttggacaccctattg

SEQ ID NO: 68803 - DNA, 18 bp, synthetic construct
  source 1..18: mol_type = other DNA
tattttaacttactatag

SEQ ID NO: 68804 - DNA, 18 bp, synthetic construct
  source 1..18: mol_type = other DNA
tattttgaccaaatatag

SEQ ID NO: 68805 - DNA, 18 bp, synthetic construct
  source 1..18: mol_type = other DNA
tattttgaccaagattag

SEQ ID NO: 68806 - DNA, 18 bp, synthetic construct
  source 1..18: mol_type = other DNA
tcaaacatttcactatag

SEQ ID NO: 68807 - DNA, 18 bp, synthetic construct
  source 1..18: mol_type = other DNA
tcaaacgccacactgtag

SEQ ID NO: 68808 - DNA, 18 bp, synthetic construct
  source 1..18: mol_type = other DNA
tcaaactacgcaccgacg

SEQ ID NO: 68809 - DNA, 18 bp, synthetic construct
  source 1..18: mol_type = other DNA
tcaatagtctcgttattg

SEQ ID NO: 68810 - DNA, 18 bp, synthetic construct
  source 1..18: mol_type = other DNA
tcaatcgaattaatatgg

SEQ ID NO: 68811 - DNA, 18 bp, synthetic construct
  source 1..18: mol_type = other DNA
tcaatcgataaattatcg

SEQ ID NO: 68812 - DNA, 18 bp, synthetic construct
  source 1..18: mol_type = other DNA
tcaatcgtctgattaaag

SEQ ID NO: 68813 - DNA, 18 bp, synthetic construct
  source 1..18: mol_type = other DNA
tcacaccacccactacag

SEQ ID NO: 68814 - DNA, 18 bp, synthetic construct
  source 1..18: mol_type = other DNA
tcacacgacacgcaatag

SEQ ID NO: 68815 - DNA, 18 bp, synthetic construct
  source 1..18: mol_type = other DNA
tcagctcaattactatag

SEQ ID NO: 68816 - DNA, 18 bp, synthetic construct
  source 1..18: mol_type = other DNA
tcagtggactcactatcg

SEQ ID NO: 68817 - DNA, 18 bp, synthetic construct
  source 1..18: mol_type = other DNA
tcataagtatcactttag

SEQ ID NO: 68818 - DNA, 18 bp, synthetic construct
  source 1..18: mol_type = other DNA
tcataagtctttctatag

SEQ ID NO: 68819 - DNA, 18 bp, synthetic construct
  source 1..18: mol_type = other DNA
tcatacaactcccatctg

SEQ ID NO: 68820 - DNA, 18 bp, synthetic construct
  source 1..18: mol_type = other DNA
tcatacagctcatttttg

SEQ ID NO: 68821 - DNA, 18 bp, synthetic construct
  source 1..18: mol_type = other DNA
tcataccaatttacatag

SEQ ID NO: 68822 - DNA, 18 bp, synthetic construct
  source 1..18: mol_type = other DNA
tcataccactatctcttg

SEQ ID NO: 68823 - DNA, 18 bp, synthetic construct
  source 1..18: mol_type = other DNA
tcataccgctgccaattg

SEQ ID NO: 68824 - DNA, 18 bp, synthetic construct
  source 1..18: mol_type = other DNA
tcatacgattcaataatg

SEQ ID NO: 68825 - DNA, 18 bp, synthetic construct
  source 1..18: mol_type = other DNA
tcatacgcctcacatcag

SEQ ID NO: 68826 - DNA, 18 bp, synthetic construct
  source 1..18: mol_type = other DNA
tcatacgcctctccttag

SEQ ID NO: 68827 - DNA, 18 bp, synthetic construct
  source 1..18: mol_type = other DNA
tcatacgcttcagtttag

SEQ ID NO: 68828 - DNA, 18 bp, synthetic construct
  source 1..18: mol_type = other DNA
tcatacgtaacactacag

SEQ ID NO: 68829 - DNA, 18 bp, synthetic construct
  source 1..18: mol_type = other DNA
tcatacgtatcgccatag

SEQ ID NO: 68830 - DNA, 18 bp, synthetic construct
  source 1..18: mol_type = other DNA
tcatacgtctcatttacg

SEQ ID NO: 68831 - DNA, 18 bp, synthetic construct
  source 1..18: mol_type = other DNA
tcatacttatgaatattg

SEQ ID NO: 68832 - DNA, 18 bp, synthetic construct
  source 1..18: mol_type = other DNA
tcatagcgatcactttag

SEQ ID NO: 68833 - DNA, 18 bp, synthetic construct
  source 1..18: mol_type = other DNA
tcataggactttctttgg

SEQ ID NO: 68834 - DNA, 18 bp, synthetic construct
  source 1..18: mol_type = other DNA
tcatataactaactattg

SEQ ID NO: 68835 - DNA, 18 bp, synthetic construct
  source 1..18: mol_type = other DNA
tcatatgacaaactattg

SEQ ID NO: 68836 - DNA, 18 bp, synthetic construct
  source 1..18: mol_type = other DNA
tcatatgtctctccatag

SEQ ID NO: 68837 - DNA, 18 bp, synthetic construct
  source 1..18: mol_type = other DNA
tcatatgtctttctgcag

SEQ ID NO: 68838 - DNA, 18 bp, synthetic construct
  source 1..18: mol_type = other DNA
tcatcattctttctattg

SEQ ID NO: 68839 - DNA, 18 bp, synthetic construct
  source 1..18: mol_type = other DNA
tcatccaattctctatag

SEQ ID NO: 68840 - DNA, 18 bp, synthetic construct
  source 1..18: mol_type = other DNA
tcatccgtctacctgcag

SEQ ID NO: 68841 - DNA, 18 bp, synthetic construct
  source 1..18: mol_type = other DNA
tcatctaaatcactaaag

SEQ ID NO: 68842 - DNA, 18 bp, synthetic construct
  source 1..18: mol_type = other DNA
tcatgagattcacgagag

SEQ ID NO: 68843 - DNA, 18 bp, synthetic construct
  source 1..18: mol_type = other DNA
tcatgcaactcactgaag

SEQ ID NO: 68844 - DNA, 18 bp, synthetic construct
  source 1..18: mol_type = other DNA
tcattcaacacactatgg

SEQ ID NO: 68845 - DNA, 18 bp, synthetic construct
  source 1..18: mol_type = other DNA
tcattcgacaccccattg

SEQ ID NO: 68846 - DNA, 18 bp, synthetic construct
  source 1..18: mol_type = other DNA
tcattcgactatcgatag

SEQ ID NO: 68847 - DNA, 18 bp, synthetic construct
  source 1..18: mol_type = other DNA
tcattcgactctcagttg

SEQ ID NO: 68848 - DNA, 18 bp, synthetic construct
  source 1..18: mol_type = other DNA
tcattctacacaccatag

SEQ ID NO: 68849 - DNA, 18 bp, synthetic construct
  source 1..18: mol_type = other DNA
tcattgcactctctcttg

SEQ ID NO: 68850 - DNA, 18 bp, synthetic construct
  source 1..18: mol_type = other DNA
tcatttgactcaatatcg

SEQ ID NO: 68851 - DNA, 18 bp, synthetic construct
  source 1..18: mol_type = other DNA
tcatttgactttctatgg

SEQ ID NO: 68852 - DNA, 18 bp, synthetic construct
  source 1..18: mol_type = other DNA
tcccacgattaattatag

SEQ ID NO: 68853 - DNA, 18 bp, synthetic construct
  source 1..18: mol_type = other DNA
tcctccgactaaccatag

SEQ ID NO: 68854 - DNA, 18 bp, synthetic construct
  source 1..18: mol_type = other DNA
tcgtatgacgaaatatag

SEQ ID NO: 68855 - DNA, 18 bp, synthetic construct
  source 1..18: mol_type = other DNA
tctaacctttcacaattg

SEQ ID NO: 68856 - DNA, 18 bp, synthetic construct
  source 1..18: mol_type = other DNA
tctaacgactgtaattag

SEQ ID NO: 68857 - DNA, 18 bp, synthetic construct
  source 1..18: mol_type = other DNA
tctatggactcactatag

SEQ ID NO: 68858 - DNA, 18 bp, synthetic construct
  source 1..18: mol_type = other DNA
tctcacggctaacacttg

SEQ ID NO: 68859 - DNA, 18 bp, synthetic construct
  source 1..18: mol_type = other DNA
tctgacgacacaccgttg

SEQ ID NO: 68860 - DNA, 18 bp, synthetic construct
  source 1..18: mol_type = other DNA
tcttacaacaaactatag

SEQ ID NO: 68861 - DNA, 18 bp, synthetic construct
  source 1..18: mol_type = other DNA
tcttacccttgagtattg

SEQ ID NO: 68862 - DNA, 18 bp, synthetic construct
  source 1..18: mol_type = other DNA
tcttacgactcaccaacg

SEQ ID NO: 68863 - DNA, 18 bp, synthetic construct
  source 1..18: mol_type = other DNA
tcttacgacttacttaag

SEQ ID NO: 68864 - DNA, 18 bp, synthetic construct
  source 1..18: mol_type = other DNA
tcttacgacttcctttag

SEQ ID NO: 68865 - DNA, 18 bp, synthetic construct
  source 1..18: mol_type = other DNA
tcttacgtctcgctaagg

SEQ ID NO: 68866 - DNA, 18 bp, synthetic construct
  source 1..18: mol_type = other DNA
tctttccacacaccagtg

SEQ ID NO: 68867 - DNA, 18 bp, synthetic construct
  source 1..18: mol_type = other DNA
tgaaaccacagactatgg

SEQ ID NO: 68868 - DNA, 18 bp, synthetic construct
  source 1..18: mol_type = other DNA
tgaaacgaaacacgacag

SEQ ID NO: 68869 - DNA, 18 bp, synthetic construct
  source 1..18: mol_type = other DNA
tgaaacgccaccctagag

SEQ ID NO: 68870 - DNA, 18 bp, synthetic construct
  source 1..18: mol_type = other DNA
tgaaacgtctctctttag

SEQ ID NO: 68871 - DNA, 18 bp, synthetic construct
  source 1..18: mol_type = other DNA
tgaaacgtcttaccttag

SEQ ID NO: 68872 - DNA, 18 bp, synthetic construct
  source 1..18: mol_type = other DNA
tgaaccgacgcactatcg

SEQ ID NO: 68873 - DNA, 18 bp, synthetic construct
  source 1..18: mol_type = other DNA
tgaacttatccacgttag

SEQ ID NO: 68874 - DNA, 18 bp, synthetic construct
  source 1..18: mol_type = other DNA
tgacacgtctcatgatag

SEQ ID NO: 68875 - DNA, 18 bp, synthetic construct
  source 1..18: mol_type = other DNA
tgacgagtctcatcttag

SEQ ID NO: 68876 - DNA, 18 bp, synthetic construct
  source 1..18: mol_type = other DNA
tgagacctctcattatag

SEQ ID NO: 68877 - DNA, 18 bp, synthetic construct
  source 1..18: mol_type = other DNA
tgagaggactcacgaacg

SEQ ID NO: 68878 - DNA, 18 bp, synthetic construct
  source 1..18: mol_type = other DNA
tgataagccacaccatag

SEQ ID NO: 68879 - DNA, 18 bp, synthetic construct
  source 1..18: mol_type = other DNA
tgatacaactcagtcgag

SEQ ID NO: 68880 - DNA, 18 bp, synthetic construct
  source 1..18: mol_type = other DNA
tgatacatctcgctaatg

SEQ ID NO: 68881 - DNA, 18 bp, synthetic construct
  source 1..18: mol_type = other DNA
tgatacatttcgcttaag

SEQ ID NO: 68882 - DNA, 18 bp, synthetic construct
  source 1..18: mol_type = other DNA
tgataccacactttatag

SEQ ID NO: 68883 - DNA, 18 bp, synthetic construct
  source 1..18: mol_type = other DNA
tgataccactctgcgaag

SEQ ID NO: 68884 - DNA, 18 bp, synthetic construct
  source 1..18: mol_type = other DNA
tgatacgactcacatatg

SEQ ID NO: 68885 - DNA, 18 bp, synthetic construct
  source 1..18: mol_type = other DNA
tgatacgactcatagaag

SEQ ID NO: 68886 - DNA, 18 bp, synthetic construct
  source 1..18: mol_type = other DNA
tgatacgactcatgcgag

SEQ ID NO: 68887 - DNA, 18 bp, synthetic construct
  source 1..18: mol_type = other DNA
tgatacgattcccaatcg

SEQ ID NO: 68888 - DNA, 18 bp, synthetic construct
  source 1..18: mol_type = other DNA
tgatacgcctctccatgg

SEQ ID NO: 68889 - DNA, 18 bp, synthetic construct
  source 1..18: mol_type = other DNA
tgatacgcctctgtacag

SEQ ID NO: 68890 - DNA, 18 bp, synthetic construct
  source 1..18: mol_type = other DNA
tgatactactttcgatag

SEQ ID NO: 68891 - DNA, 18 bp, synthetic construct
  source 1..18: mol_type = other DNA
tgataggccttactttag

SEQ ID NO: 68892 - DNA, 18 bp, synthetic construct
  source 1..18: mol_type = other DNA
tgatagttctccctattg

SEQ ID NO: 68893 - DNA, 18 bp, synthetic construct
  source 1..18: mol_type = other DNA
tgatatgtctcgcaatag

SEQ ID NO: 68894 - DNA, 18 bp, synthetic construct
  source 1..18: mol_type = other DNA
tgatattaatcactaggg

SEQ ID NO: 68895 - DNA, 18 bp, synthetic construct
  source 1..18: mol_type = other DNA
tgatatttgtcactatag

SEQ ID NO: 68896 - DNA, 18 bp, synthetic construct
  source 1..18: mol_type = other DNA
tgatcagacttactaata

SEQ ID NO: 68897 - DNA, 18 bp, synthetic construct
  source 1..18: mol_type = other DNA
tgattagtctaactattg

SEQ ID NO: 68898 - DNA, 18 bp, synthetic construct
  source 1..18: mol_type = other DNA
tgattcaactcacttgtg

SEQ ID NO: 68899 - DNA, 18 bp, synthetic construct
  source 1..18: mol_type = other DNA
tgattcaactcgttattg

SEQ ID NO: 68900 - DNA, 18 bp, synthetic construct
  source 1..18: mol_type = other DNA
tgattccactcgctcttg

SEQ ID NO: 68901 - DNA, 18 bp, synthetic construct
  source 1..18: mol_type = other DNA
tgattcgacaaactacag

SEQ ID NO: 68902 - DNA, 18 bp, synthetic construct
  source 1..18: mol_type = other DNA
tgattcgactctttctag

SEQ ID NO: 68903 - DNA, 18 bp, synthetic construct
  source 1..18: mol_type = other DNA
tgattcgcttctccaaag

SEQ ID NO: 68904 - DNA, 18 bp, synthetic construct
  source 1..18: mol_type = other DNA
tgattcgcttcttgatag

SEQ ID NO: 68905 - DNA, 18 bp, synthetic construct
  source 1..18: mol_type = other DNA
tgattcgtcattcaatag

SEQ ID NO: 68906 - DNA, 18 bp, synthetic construct
  source 1..18: mol_type = other DNA
tgattcgtctcaatattg

SEQ ID NO: 68907 - DNA, 18 bp, synthetic construct
  source 1..18: mol_type = other DNA
tgattctaatccctatag

SEQ ID NO: 68908 - DNA, 18 bp, synthetic construct
  source 1..18: mol_type = other DNA
tgcaacgacttacaatag

SEQ ID NO: 68909 - DNA, 18 bp, synthetic construct
  source 1..18: mol_type = other DNA
tgctacaactcagtaacg

SEQ ID NO: 68910 - DNA, 18 bp, synthetic construct
  source 1..18: mol_type = other DNA
tggttcaacatactatag

SEQ ID NO: 68911 - DNA, 18 bp, synthetic construct
  source 1..18: mol_type = other DNA
tgtaacgacttacttcag

SEQ ID NO: 68912 - DNA, 18 bp, synthetic construct
  source 1..18: mol_type = other DNA
tgtaactactctgcatag

SEQ ID NO: 68913 - DNA, 18 bp, synthetic construct
  source 1..18: mol_type = other DNA
tgttacgaaacattattg

SEQ ID NO: 68914 - DNA, 18 bp, synthetic construct
  source 1..18: mol_type = other DNA
tgttacgacacatttatg

SEQ ID NO: 68915 - DNA, 18 bp, synthetic construct
  source 1..18: mol_type = other DNA
tgttacgactaaccagag

SEQ ID NO: 68916 - DNA, 18 bp, synthetic construct
  source 1..18: mol_type = other DNA
tgttacgactcagttaag

SEQ ID NO: 68917 - DNA, 18 bp, synthetic construct
  source 1..18: mol_type = other DNA
tgttacgatcctatatag

SEQ ID NO: 68918 - DNA, 18 bp, synthetic construct
  source 1..18: mol_type = other DNA
tgttacgccttacttttg

SEQ ID NO: 68919 - DNA, 18 bp, synthetic construct
  source 1..18: mol_type = other DNA
tgttacgcctttctatag

SEQ ID NO: 68920 - DNA, 18 bp, synthetic construct
  source 1..18: mol_type = other DNA
tgttacggcttaatacag

SEQ ID NO: 68921 - DNA, 18 bp, synthetic construct
  source 1..18: mol_type = other DNA
tgttacgtccctttaatg

SEQ ID NO: 68922 - DNA, 18 bp, synthetic construct
  source 1..18: mol_type = other DNA
tgttacgtctcaccatcg

SEQ ID NO: 68923 - DNA, 18 bp, synthetic construct
  source 1..18: mol_type = other DNA
tgttacgtctgactgtag

SEQ ID NO: 68924 - DNA, 18 bp, synthetic construct
  source 1..18: mol_type = other DNA
tgttactactcaatttag

SEQ ID NO: 68925 - DNA, 18 bp, synthetic construct
  source 1..18: mol_type = other DNA
tgttactccacactattg

SEQ ID NO: 68926 - DNA, 18 bp, synthetic construct
  source 1..18: mol_type = other DNA
tgttccgtctccctatcg

SEQ ID NO: 68927 - DNA, 18 bp, synthetic construct
  source 1..18: mol_type = other DNA
ttaaaatactcactgtag

SEQ ID NO: 68928 - DNA, 18 bp, synthetic construct
  source 1..18: mol_type = other DNA
ttaaacaactcactactg

SEQ ID NO: 68929 - DNA, 18 bp, synthetic construct
  source 1..18: mol_type = other DNA
ttaaacgaaacactgtgg

SEQ ID NO: 68930 - DNA, 18 bp, synthetic construct
  source 1..18: mol_type = other DNA
ttaaacgaatcattatgg

SEQ ID NO: 68931 - DNA, 18 bp, synthetic construct
  source 1..18: mol_type = other DNA
ttaaacgactgaccttag

SEQ ID NO: 68932 - DNA, 18 bp, synthetic construct
  source 1..18: mol_type = other DNA
ttaaactactacctatag

SEQ ID NO: 68933 - DNA, 18 bp, synthetic construct
  source 1..18: mol_type = other DNA
ttaaactattcgcactag

SEQ ID NO: 68934 - DNA, 18 bp, synthetic construct
  source 1..18: mol_type = other DNA
ttaaagcactcacctttg

SEQ ID NO: 68935 - DNA, 18 bp, synthetic construct
  source 1..18: mol_type = other DNA
ttaaaggactcattaaag

SEQ ID NO: 68936 - DNA, 18 bp, synthetic construct
  source 1..18: mol_type = other DNA
ttaaagggcatactttag

SEQ ID NO: 68937 - DNA, 18 bp, synthetic construct
  source 1..18: mol_type = other DNA
ttaaatgactcacaatgg

SEQ ID NO: 68938 - DNA, 18 bp, synthetic construct
  source 1..18: mol_type = other DNA
ttaaatgactcacttcgg

SEQ ID NO: 68939 - DNA, 18 bp, synthetic construct
  source 1..18: mol_type = other DNA
ttaaatgtctcactaggg

SEQ ID NO: 68940 - DNA, 18 bp, synthetic construct
  source 1..18: mol_type = other DNA
ttaaatgtctcactgtag

SEQ ID NO: 68941 - DNA, 18 bp, synthetic construct
  source 1..18: mol_type = other DNA
ttaagggacaaactattg

SEQ ID NO: 68942 - DNA, 18 bp, synthetic construct
  source 1..18: mol_type = other DNA
ttaatcgactcacaacag

SEQ ID NO: 68943 - DNA, 18 bp, synthetic construct
  source 1..18: mol_type = other DNA
ttaatcgtctcaccatag

SEQ ID NO: 68944 - DNA, 18 bp, synthetic construct
  source 1..18: mol_type = other DNA
ttaatctactccctacag

SEQ ID NO: 68945 - DNA, 18 bp, synthetic construct
  source 1..18: mol_type = other DNA
ttacaccaatctctaatg

SEQ ID NO: 68946 - DNA, 18 bp, synthetic construct
  source 1..18: mol_type = other DNA
ttacacgcaccacaatag

SEQ ID NO: 68947 - DNA, 18 bp, synthetic construct
  source 1..18: mol_type = other DNA
ttacacgcctccctaaag

SEQ ID NO: 68948 - DNA, 18 bp, synthetic construct
  source 1..18: mol_type = other DNA
ttacactactcatgatag

SEQ ID NO: 68949 - DNA, 18 bp, synthetic construct
  source 1..18: mol_type = other DNA
ttacactattctttatag

SEQ ID NO: 68950 - DNA, 18 bp, synthetic construct
  source 1..18: mol_type = other DNA
ttacatgactctcaatag

SEQ ID NO: 68951 - DNA, 18 bp, synthetic construct
  source 1..18: mol_type = other DNA
ttacccgattcaatattg

SEQ ID NO: 68952 - DNA, 18 bp, synthetic construct
  source 1..18: mol_type = other DNA
ttacgcctaactctattg

SEQ ID NO: 68953 - DNA, 18 bp, synthetic construct
  source 1..18: mol_type = other DNA
ttactcgaattacttcag

SEQ ID NO: 68954 - DNA, 18 bp, synthetic construct
  source 1..18: mol_type = other DNA
ttactcgacttaccatag

SEQ ID NO: 68955 - DNA, 18 bp, synthetic construct
  source 1..18: mol_type = other DNA
ttagactacacaccatag

SEQ ID NO: 68956 - DNA, 18 bp, synthetic construct
  source 1..18: mol_type = other DNA
ttataacacacaccttag

SEQ ID NO: 68957 - DNA, 18 bp, synthetic construct
  source 1..18: mol_type = other DNA
ttataagaataacaaaag

SEQ ID NO: 68958 - DNA, 18 bp, synthetic construct
  source 1..18: mol_type = other DNA
ttataagactcactcagg

SEQ ID NO: 68959 - DNA, 18 bp, synthetic construct
  source 1..18: mol_type = other DNA
ttataagactcccattag

SEQ ID NO: 68960 - DNA, 18 bp, synthetic construct
  source 1..18: mol_type = other DNA
ttataagattcacaattg

SEQ ID NO: 68961 - DNA, 18 bp, synthetic construct
  source 1..18: mol_type = other DNA
ttataatacacgctatag

SEQ ID NO: 68962 - DNA, 18 bp, synthetic construct
  source 1..18: mol_type = other DNA
ttatacaaatcactaacg

SEQ ID NO: 68963 - DNA, 18 bp, synthetic construct
  source 1..18: mol_type = other DNA
ttatacaactctttcaag

SEQ ID NO: 68964 - DNA, 18 bp, synthetic construct
  source 1..18: mol_type = other DNA
ttatacaactttaaatgg

SEQ ID NO: 68965 - DNA, 18 bp, synthetic construct
  source 1..18: mol_type = other DNA
ttatacaagcccatttag

SEQ ID NO: 68966 - DNA, 18 bp, synthetic construct
  source 1..18: mol_type = other DNA
ttatacaatttcctatag

SEQ ID NO: 68967 - DNA, 18 bp, synthetic construct
  source 1..18: mol_type = other DNA
ttatacatctcattcttg

SEQ ID NO: 68968 - DNA, 18 bp, synthetic construct
  source 1..18: mol_type = other DNA
ttataccatacactattg

SEQ ID NO: 68969 - DNA, 18 bp, synthetic construct
  source 1..18: mol_type = other DNA
ttataccatactcaatag

SEQ ID NO: 68970 - DNA, 18 bp, synthetic construct
  source 1..18: mol_type = other DNA
ttatacccctctctgtag

SEQ ID NO: 68971 - DNA, 18 bp, synthetic construct
  source 1..18: mol_type = other DNA
ttatacgaatatctaatg

SEQ ID NO: 68972 - DNA, 18 bp, synthetic construct
  source 1..18: mol_type = other DNA
ttatacgacacatttttg

SEQ ID NO: 68973 - DNA, 18 bp, synthetic construct
  source 1..18: mol_type = other DNA
ttatacgacccacaaatg

SEQ ID NO: 68974 - DNA, 18 bp, synthetic construct
  source 1..18: mol_type = other DNA
ttatacgactcccttacg

SEQ ID NO: 68975 - DNA, 18 bp, synthetic construct
  source 1..18: mol_type = other DNA
ttatacgacttaacttag

SEQ ID NO: 68976 - DNA, 18 bp, synthetic construct
  source 1..18: mol_type = other DNA
ttatacgagccaaacaag

SEQ ID NO: 68977 - DNA, 18 bp, synthetic construct
  source 1..18: mol_type = other DNA
ttatacgatatactttag

SEQ ID NO: 68978 - DNA, 18 bp, synthetic construct
  source 1..18: mol_type = other DNA
ttatacgatttacatttg

SEQ ID NO: 68979 - DNA, 18 bp, synthetic construct
  source 1..18: mol_type = other DNA
ttatacgccacacattag

SEQ ID NO: 68980 - DNA, 18 bp, synthetic construct
  source 1..18: mol_type = other DNA
ttatacgcgcctaactag

SEQ ID NO: 68981 - DNA, 18 bp, synthetic construct
  source 1..18: mol_type = other DNA
ttatacgtatcatcaaag

SEQ ID NO: 68982 - DNA, 18 bp, synthetic construct
  source 1..18: mol_type = other DNA
ttatacgtcaagcaatag

SEQ ID NO: 68983 - DNA, 18 bp, synthetic construct
  source 1..18: mol_type = other DNA
ttatacgtcactccactg

SEQ ID NO: 68984 - DNA, 18 bp, synthetic construct
  source 1..18: mol_type = other DNA
ttatacgtcgccctttag

SEQ ID NO: 68985 - DNA, 18 bp, synthetic construct
  source 1..18: mol_type = other DNA
ttatacgtctatcaattg

SEQ ID NO: 68986 - DNA, 18 bp, synthetic construct
  source 1..18: mol_type = other DNA
ttatacgtctctttaaag

SEQ ID NO: 68987 - DNA, 18 bp, synthetic construct
  source 1..18: mol_type = other DNA
ttatacgtctttataaag

SEQ ID NO: 68988 - DNA, 18 bp, synthetic construct
  source 1..18: mol_type = other DNA
ttatactaatctctctag

SEQ ID NO: 68989 - DNA, 18 bp, synthetic construct
  source 1..18: mol_type = other DNA
ttatactacccattctag

SEQ ID NO: 68990 - DNA, 18 bp, synthetic construct
  source 1..18: mol_type = other DNA
ttatactacttaccaatg

SEQ ID NO: 68991 - DNA, 18 bp, synthetic construct
  source 1..18: mol_type = other DNA
ttatactacttacgattg

SEQ ID NO: 68992 - DNA, 18 bp, synthetic construct
  source 1..18: mol_type = other DNA
ttatactacttcatcttg

SEQ ID NO: 68993 - DNA, 18 bp, synthetic construct
  source 1..18: mol_type = other DNA
ttatacttctcaccatcg

SEQ ID NO: 68994 - DNA, 18 bp, synthetic construct
  source 1..18: mol_type = other DNA
ttataggtctaacaacag

SEQ ID NO: 68995 - DNA, 18 bp, synthetic construct
  source 1..18: mol_type = other DNA
ttataggtctcattttag

SEQ ID NO: 68996 - DNA, 18 bp, synthetic construct
  source 1..18: mol_type = other DNA
ttataggtctgagcattg

SEQ ID NO: 68997 - DNA, 18 bp, synthetic construct
  source 1..18: mol_type = other DNA
ttatagttctcactttcg

SEQ ID NO: 68998 - DNA, 18 bp, synthetic construct
  source 1..18: mol_type = other DNA
ttatatcactcactaatg

SEQ ID NO: 68999 - DNA, 18 bp, synthetic construct
  source 1..18: mol_type = other DNA
ttatatctcacactaaag

SEQ ID NO: 69000 - DNA, 18 bp, synthetic construct
  source 1..18: mol_type = other DNA
ttatatgacacatcatag

SEQ ID NO: 69001 - DNA, 18 bp, synthetic construct
  source 1..18: mol_type = other DNA
ttatatgacagtctatag

SEQ ID NO: 69002 - DNA, 18 bp, synthetic construct
  source 1..18: mol_type = other DNA
ttatatgacatactttag

SEQ ID NO: 69003 - DNA, 18 bp, synthetic construct
  source 1..18: mol_type = other DNA
ttatatgactaattcaag

SEQ ID NO: 69004 - DNA, 18 bp, synthetic construct
  source 1..18: mol_type = other DNA
ttatatggctcataatag

SEQ ID NO: 69005 - DNA, 18 bp, synthetic construct
  source 1..18: mol_type = other DNA
ttatatgtctgactacag

SEQ ID NO: 69006 - DNA, 18 bp, synthetic construct
  source 1..18: mol_type = other DNA
ttatattcatctctatag

SEQ ID NO: 69007 - DNA, 18 bp, synthetic construct
  source 1..18: mol_type = other DNA
ttatccgaatctctttag

SEQ ID NO: 69008 - DNA, 18 bp, synthetic construct
  source 1..18: mol_type = other DNA
ttatccgaatgactattg

SEQ ID NO: 69009 - DNA, 18 bp, synthetic construct
  source 1..18: mol_type = other DNA
ttatccgacacactggtg

SEQ ID NO: 69010 - DNA, 18 bp, synthetic construct
  source 1..18: mol_type = other DNA
ttatccgactctttttag

SEQ ID NO: 69011 - DNA, 18 bp, synthetic construct
  source 1..18: mol_type = other DNA
ttatccgactgacgagag

SEQ ID NO: 69012 - DNA, 18 bp, synthetic construct
  source 1..18: mol_type = other DNA
ttatccgtctcaccgtag

SEQ ID NO: 69013 - DNA, 18 bp, synthetic construct
  source 1..18: mol_type = other DNA
ttatccgtctctttattg

SEQ ID NO: 69014 - DNA, 18 bp, synthetic construct
  source 1..18: mol_type = other DNA
ttatctgactcacgttcg

SEQ ID NO: 69015 - DNA, 18 bp, synthetic construct
  source 1..18: mol_type = other DNA
ttatgagactcaccgtag

SEQ ID NO: 69016 - DNA, 18 bp, synthetic construct
  source 1..18: mol_type = other DNA
ttatgcaagtgacaatag

SEQ ID NO: 69017 - DNA, 18 bp, synthetic construct
  source 1..18: mol_type = other DNA
ttatgcatctcactaaag

SEQ ID NO: 69018 - DNA, 18 bp, synthetic construct
  source 1..18: mol_type = other DNA
ttatgcgactttctaatg

SEQ ID NO: 69019 - DNA, 18 bp, synthetic construct
  source 1..18: mol_type = other DNA
ttatgcgtctccctttcg

SEQ ID NO: 69020 - DNA, 18 bp, synthetic construct
  source 1..18: mol_type = other DNA
ttatgcgtttcactattg

SEQ ID NO: 69021 - DNA, 18 bp, synthetic construct
  source 1..18: mol_type = other DNA
ttatgtaaccaagtatag

SEQ ID NO: 69022 - DNA, 18 bp, synthetic construct
  source 1..18: mol_type = other DNA
ttatgtgacacaatgtgg

SEQ ID NO: 69023 - DNA, 18 bp, synthetic construct
  source 1..18: mol_type = other DNA
ttatgttacacattattg

SEQ ID NO: 69024 - DNA, 18 bp, synthetic construct
  source 1..18: mol_type = other DNA
ttattacatcacctatag

SEQ ID NO: 69025 - DNA, 18 bp, synthetic construct
  source 1..18: mol_type = other DNA
ttattcaacactctatag

SEQ ID NO: 69026 - DNA, 18 bp, synthetic construct
  source 1..18: mol_type = other DNA
ttattcaacactcttttg

SEQ ID NO: 69027 - DNA, 18 bp, synthetic construct
  source 1..18: mol_type = other DNA
ttattcaattcgccaaag

SEQ ID NO: 69028 - DNA, 18 bp, synthetic construct
  source 1..18: mol_type = other DNA
ttattcatccctctatag

SEQ ID NO: 69029 - DNA, 18 bp, synthetic construct
  source 1..18: mol_type = other DNA
ttattcctctccctatag

SEQ ID NO: 69030 - DNA, 18 bp, synthetic construct
  source 1..18: mol_type = other DNA
ttattcgactccgtgtag

SEQ ID NO: 69031 - DNA, 18 bp, synthetic construct
  source 1..18: mol_type = other DNA
ttattcgactctccttag

SEQ ID NO: 69032 - DNA, 18 bp, synthetic construct
  source 1..18: mol_type = other DNA
ttattcgagtcagacttg

SEQ ID NO: 69033 - DNA, 18 bp, synthetic construct
  source 1..18: mol_type = other DNA
ttattcggcttactatcg

SEQ ID NO: 69034 - DNA, 18 bp, synthetic construct
  source 1..18: mol_type = other DNA
ttattctaattactatag

SEQ ID NO: 69035 - DNA, 18 bp, synthetic construct
  source 1..18: mol_type = other DNA
ttattctatcaagttcag

SEQ ID NO: 69036 - DNA, 18 bp, synthetic construct
  source 1..18: mol_type = other DNA
ttattctcttcactgtcg

SEQ ID NO: 69037 - DNA, 18 bp, synthetic construct
  source 1..18: mol_type = other DNA
ttattcttctcactcatg

SEQ ID NO: 69038 - DNA, 18 bp, synthetic construct
  source 1..18: mol_type = other DNA
ttattcttctctctagcg

SEQ ID NO: 69039 - DNA, 18 bp, synthetic construct
  source 1..18: mol_type = other DNA
ttatttaattcactatag

SEQ ID NO: 69040 - DNA, 18 bp, synthetic construct
  source 1..18: mol_type = other DNA
ttatttatctcactatag

SEQ ID NO: 69041 - DNA, 18 bp, synthetic construct
  source 1..18: mol_type = other DNA
ttatttgattcactgtag

SEQ ID NO: 69042 - DNA, 18 bp, synthetic construct
  source 1..18: mol_type = other DNA
ttcaacgtatcacactag

SEQ ID NO: 69043 - DNA, 18 bp, synthetic construct
  source 1..18: mol_type = other DNA
ttcaatgtaacactatag

SEQ ID NO: 69044 - DNA, 18 bp, synthetic construct
  source 1..18: mol_type = other DNA
ttcagctaatcactatag

SEQ ID NO: 69045 - DNA, 18 bp, synthetic construct
  source 1..18: mol_type = other DNA
ttctaaggctgactatag

SEQ ID NO: 69046 - DNA, 18 bp, synthetic construct
  source 1..18: mol_type = other DNA
ttctagcactaacaatag

SEQ ID NO: 69047 - DNA, 18 bp, synthetic construct
  source 1..18: mol_type = other DNA
ttgaacaactcactatgg

SEQ ID NO: 69048 - DNA, 18 bp, synthetic construct
  source 1..18: mol_type = other DNA
ttgcacaacactctctag

SEQ ID NO: 69049 - DNA, 18 bp, synthetic construct
  source 1..18: mol_type = other DNA
ttgtacaactgactttag

SEQ ID NO: 69050 - DNA, 18 bp, synthetic construct
  source 1..18: mol_type = other DNA
ttgtacgactctaactag

SEQ ID NO: 69051 - DNA, 18 bp, synthetic construct
  source 1..18: mol_type = other DNA
ttgtatcactcaatatag

SEQ ID NO: 69052 - DNA, 18 bp, synthetic construct
  source 1..18: mol_type = other DNA
ttgtgcgagtcactttgg

SEQ ID NO: 69053 - DNA, 18 bp, synthetic construct
  source 1..18: mol_type = other DNA
ttgttcccatatctatag

SEQ ID NO: 69054 - DNA, 18 bp, synthetic construct
  source 1..18: mol_type = other DNA
ttgtttgactcacaatag

SEQ ID NO: 69055 - DNA, 18 bp, synthetic construct
  source 1..18: mol_type = other DNA
tttaacgtcttccaatag

SEQ ID NO: 69056 - DNA, 18 bp, synthetic construct
  source 1..18: mol_type = other DNA
tttagtgacttactatag

SEQ ID NO: 69057 - DNA, 18 bp, synthetic construct
  source 1..18: mol_type = other DNA
tttcttgactaactaaag

SEQ ID NO: 69058 - DNA, 18 bp, synthetic construct
  source 1..18: mol_type = other DNA
ttttaagactcactaacg

SEQ ID NO: 69059 - DNA, 18 bp, synthetic construct
  source 1..18: mol_type = other DNA
ttttaagtctcacttcag

SEQ ID NO: 69060 - DNA, 18 bp, synthetic construct
  source 1..18: mol_type = other DNA
ttttacaactcgctatcg

SEQ ID NO: 69061 - DNA, 18 bp, synthetic construct
  source 1..18: mol_type = other DNA
ttttacaattcacttatg

SEQ ID NO: 69062 - DNA, 18 bp, synthetic construct
  source 1..18: mol_type = other DNA
ttttacgaatctgtaaag

SEQ ID NO: 69063 - DNA, 18 bp, synthetic construct
  source 1..18: mol_type = other DNA
ttttacgacatactttag

SEQ ID NO: 69064 - DNA, 18 bp, synthetic construct
  source 1..18: mol_type = other DNA
ttttacgacgcagtattg

SEQ ID NO: 69065 - DNA, 18 bp, synthetic construct
  source 1..18: mol_type = other DNA
ttttacgactcatttttg

SEQ ID NO: 69066 - DNA, 18 bp, synthetic construct
  source 1..18: mol_type = other DNA
ttttacgtctctctatcg

SEQ ID NO: 69067 - DNA, 18 bp, synthetic construct
  source 1..18: mol_type = other DNA
ttttactacctactatag

SEQ ID NO: 69068 - DNA, 18 bp, synthetic construct
  source 1..18: mol_type = other DNA
ttttactactctctagag

SEQ ID NO: 69069 - DNA, 18 bp, synthetic construct
  source 1..18: mol_type = other DNA
ttttactactttccatag

SEQ ID NO: 69070 - DNA, 18 bp, synthetic construct
  source 1..18: mol_type = other DNA
ttttaggagtcgttattg

SEQ ID NO: 69071 - DNA, 18 bp, synthetic construct
  source 1..18: mol_type = other DNA
ttttatgtcttactatag

SEQ ID NO: 69072 - DNA, 18 bp, synthetic construct
  source 1..18: mol_type = other DNA
ttttgcgattgacaacag

SEQ ID NO: 69073 - DNA, 18 bp, synthetic construct
  source 1..18: mol_type = other DNA
ttttgggattgagtctag

SEQ ID NO: 69074 - DNA, 18 bp, synthetic construct
  source 1..18: mol_type = other DNA
tttttagactctctatag

SEQ ID NO: 69075 - DNA, 18 bp, synthetic construct
  source 1..18: mol_type = other DNA
tttttagattcactatag

SEQ ID NO: 69076 - DNA, 18 bp, synthetic construct
  source 1..18: mol_type = other DNA
tttttagtctcactatgg

SEQ ID NO: 69077 - DNA, 18 bp, synthetic construct
  source 1..18: mol_type = other DNA
tttttcaactcaataaag

SEQ ID NO: 69078 - DNA, 18 bp, synthetic construct
  source 1..18: mol_type = other DNA
aaacacgactctcaattg

SEQ ID NO: 69079 - DNA, 18 bp, synthetic construct
  source 1..18: mol_type = other DNA
aaatacgtatcactgttg

SEQ ID NO: 69080 - DNA, 18 bp, synthetic construct
  source 1..18: mol_type = other DNA
taatacctatcattatcg

SEQ ID NO: 69081 - DNA, 18 bp, synthetic construct
  source 1..18: mol_type = other DNA
taattcttctcacagtag

SEQ ID NO: 69082 - DNA, 18 bp, synthetic construct
  source 1..18: mol_type = other DNA
tatatcgacacactattg

SEQ ID NO: 69083 - DNA, 18 bp, synthetic construct
  source 1..18: mol_type = other DNA
tatctcaactgcctatag

SEQ ID NO: 69084 - DNA, 18 bp, synthetic construct
  source 1..18: mol_type = other DNA
tattacgtttcaaaatag

SEQ ID NO: 69085 - DNA, 18 bp, synthetic construct
  source 1..18: mol_type = other DNA
tatttcaactctcaatag

SEQ ID NO: 69086 - DNA, 18 bp, synthetic construct
  source 1..18: mol_type = other DNA
tatttcggcacaccattg

SEQ ID NO: 69087 - DNA, 18 bp, synthetic construct
  source 1..18: mol_type = other DNA
tcatacgtcatactattg

SEQ ID NO: 69088 - DNA, 18 bp, synthetic construct
  source 1..18: mol_type = other DNA
ttatacttcactctaaag

SEQ ID NO: 69089 - DNA, 18 bp, synthetic construct
  source 1..18: mol_type = other DNA
ttataggactttccatag

SEQ ID NO: 69090 - DNA, 18 bp, synthetic construct
  source 1..18: mol_type = other DNA
ttttctgtctcactatag

SEQ ID NO: 69091 - DNA, 18 bp, synthetic construct
  source 1..18: mol_type = other DNA
ttaatctactcactttag

SEQ ID NO: 69092 - DNA, 18 bp, synthetic construct
  source 1..18: mol_type = other DNA
aaatacgtcacaccaaag

SEQ ID NO: 69093 - DNA, 18 bp, synthetic construct
  source 1..18: mol_type = other DNA
aattacgttacactatag

SEQ ID NO: 69094 - DNA, 18 bp, synthetic construct
  source 1..18: mol_type = other DNA
aattacttctctctatag

SEQ ID NO: 69095 - DNA, 18 bp, synthetic construct
  source 1..18: mol_type = other DNA
atatacgactctttaaag

SEQ ID NO: 69096 - DNA, 18 bp, synthetic construct
  source 1..18: mol_type = other DNA
ctcatcgactaagtctag

SEQ ID NO: 69097 - DNA, 18 bp, synthetic construct
  source 1..18: mol_type = other DNA
taaaaaaattcactaaag

SEQ ID NO: 69098 - DNA, 18 bp, synthetic construct
  source 1..18: mol_type = other DNA
taacccaactctcaatgg

SEQ ID NO: 69099 - DNA, 18 bp, synthetic construct
  source 1..18: mol_type = other DNA
tattacttatctctatag

SEQ ID NO: 69100 - DNA, 18 bp, synthetic construct
  source 1..18: mol_type = other DNA
tcatacgacattctatcg

SEQ ID NO: 69101 - DNA, 18 bp, synthetic construct
  source 1..18: mol_type = other DNA
ttacatgactcacaattg

SEQ ID NO: 69102 - DNA, 18 bp, synthetic construct
  source 1..18: mol_type = other DNA
ttatacgactttcttaag

SEQ ID NO: 69103 - DNA, 18 bp, synthetic construct
  source 1..18: mol_type = other DNA
ttatacttctccatatag

SEQ ID NO: 69104 - DNA, 18 bp, synthetic construct
  source 1..18: mol_type = other DNA
ttattcgtctctctttag

SEQ ID NO: 69105 - DNA, 18 bp, synthetic construct
  source 1..18: mol_type = other DNA
ttattcttctctctatag

SEQ ID NO: 69106 - DNA, 18 bp, synthetic construct
  source 1..18: mol_type = other DNA
ttttacgactcgcattag

SEQ ID NO: 69107 - DNA, 18 bp, synthetic construct
  source 1..18: mol_type = other DNA
aaaaaagactcactcttg

SEQ ID NO: 69108 - DNA, 18 bp, synthetic construct
  source 1..18: mol_type = other DNA
aaaaaccgctcaataaag

SEQ ID NO: 69109 - DNA, 18 bp, synthetic construct
  source 1..18: mol_type = other DNA
aaaaacgacactttatag

SEQ ID NO: 69110 - DNA, 18 bp, synthetic construct
  source 1..18: mol_type = other DNA
aaaaacgtcccacaacag

SEQ ID NO: 69111 - DNA, 18 bp, synthetic construct
  source 1..18: mol_type = other DNA
aaaaccgactcgctacag

SEQ ID NO: 69112 - DNA, 18 bp, synthetic construct
  source 1..18: mol_type = other DNA
aaaatcgactgtcaatag

SEQ ID NO: 69113 - DNA, 18 bp, synthetic construct
  source 1..18: mol_type = other DNA
aaaattgactcactaaag

SEQ ID NO: 69114 - DNA, 18 bp, synthetic construct
  source 1..18: mol_type = other DNA
aaacacgcattcatatag

SEQ ID NO: 69115 - DNA, 18 bp, synthetic construct
  source 1..18: mol_type = other DNA
aaacacgtctcacttttg

SEQ ID NO: 69116 - DNA, 18 bp, synthetic construct
  source 1..18: mol_type = other DNA
aaacactactaactaatg

SEQ ID NO: 69117 - DNA, 18 bp, synthetic construct
  source 1..18: mol_type = other DNA
aaacagaaatcaccattg

SEQ ID NO: 69118 - DNA, 18 bp, synthetic construct
  source 1..18: mol_type = other DNA
aaaccctaatcactatag

SEQ ID NO: 69119 - DNA, 18 bp, synthetic construct
  source 1..18: mol_type = other DNA
aaagacaattcactacag

SEQ ID NO: 69120 - DNA, 18 bp, synthetic construct
  source 1..18: mol_type = other DNA
aaataacactcacttaag

SEQ ID NO: 69121 - DNA, 18 bp, synthetic construct
  source 1..18: mol_type = other DNA
aaataactctctctacag

SEQ ID NO: 69122 - DNA, 18 bp, synthetic construct
  source 1..18: mol_type = other DNA
aaataagaatctcaatag

SEQ ID NO: 69123 - DNA, 18 bp, synthetic construct
  source 1..18: mol_type = other DNA
aaatacatgtcacaatag

SEQ ID NO: 69124 - DNA, 18 bp, synthetic construct
  source 1..18: mol_type = other DNA
aaatacgaatcaatactg

SEQ ID NO: 69125 - DNA, 18 bp, synthetic construct
  source 1..18: mol_type = other DNA
aaatacgactcaaattgg

SEQ ID NO: 69126 - DNA, 18 bp, synthetic construct
  source 1..18: mol_type = other DNA
aaatacgactcataaatg

SEQ ID NO: 69127 - DNA, 18 bp, synthetic construct
  source 1..18: mol_type = other DNA
aaatacgactttcagttg

SEQ ID NO: 69128 - DNA, 18 bp, synthetic construct
  source 1..18: mol_type = other DNA
aaatacgcgccactattg

SEQ ID NO: 69129 - DNA, 18 bp, synthetic construct
  source 1..18: mol_type = other DNA
aaatacgtctcccaatcg

SEQ ID NO: 69130 - DNA, 18 bp, synthetic construct
  source 1..18: mol_type = other DNA
aaatactacacactactg

SEQ ID NO: 69131 - DNA, 18 bp, synthetic construct
  source 1..18: mol_type = other DNA
aaatactattctatatag

SEQ ID NO: 69132 - DNA, 18 bp, synthetic construct
  source 1..18: mol_type = other DNA
aaatacttctatctaaag

SEQ ID NO: 69133 - DNA, 18 bp, synthetic construct
  source 1..18: mol_type = other DNA
aaatacttctcattctcg

SEQ ID NO: 69134 - DNA, 18 bp, synthetic construct
  source 1..18: mol_type = other DNA
aaataggcaacactttag

SEQ ID NO: 69135 - DNA, 18 bp, synthetic construct
  source 1..18: mol_type = other DNA
aaatatagcccactattg

SEQ ID NO: 69136 - DNA, 18 bp, synthetic construct
  source 1..18: mol_type = other DNA
aaatatcacgaactttag

SEQ ID NO: 69137 - DNA, 18 bp, synthetic construct
  source 1..18: mol_type = other DNA
aaatatgacaaaccaatg

SEQ ID NO: 69138 - DNA, 18 bp, synthetic construct
  source 1..18: mol_type = other DNA
aaatatgacgctttattg

SEQ ID NO: 69139 - DNA, 18 bp, synthetic construct
  source 1..18: mol_type = other DNA
aaatatgtcgcaaaattg

SEQ ID NO: 69140 - DNA, 18 bp, synthetic construct
  source 1..18: mol_type = other DNA
aaatcagactatctatag

SEQ ID NO: 69141 - DNA, 18 bp, synthetic construct
  source 1..18: mol_type = other DNA
aaatcatacttacaaaag

SEQ ID NO: 69142 - DNA, 18 bp, synthetic construct
  source 1..18: mol_type = other DNA
aaatccaactcaataaag

SEQ ID NO: 69143 - DNA, 18 bp, synthetic construct
  source 1..18: mol_type = other DNA
aaatcccactcacattag

SEQ ID NO: 69144 - DNA, 18 bp, synthetic construct
  source 1..18: mol_type = other DNA
aaatccgattcaatttag

SEQ ID NO: 69145 - DNA, 18 bp, synthetic construct
  source 1..18: mol_type = other DNA
aaatgcgacacactaatg

SEQ ID NO: 69146 - DNA, 18 bp, synthetic construct
  source 1..18: mol_type = other DNA
aaatgctattcactacag

SEQ ID NO: 69147 - DNA, 18 bp, synthetic construct
  source 1..18: mol_type = other DNA
aaattcaactcagaaagg

SEQ ID NO: 69148 - DNA, 18 bp, synthetic construct
  source 1..18: mol_type = other DNA
aaattcgaatcacaaaag

SEQ ID NO: 69149 - DNA, 18 bp, synthetic construct
  source 1..18: mol_type = other DNA
aaattcgactctccattg

SEQ ID NO: 69150 - DNA, 18 bp, synthetic construct
  source 1..18: mol_type = other DNA
aaattcgactcttcatag

SEQ ID NO: 69151 - DNA, 18 bp, synthetic construct
  source 1..18: mol_type = other DNA
aaattcgactctttaaag

SEQ ID NO: 69152 - DNA, 18 bp, synthetic construct
  source 1..18: mol_type = other DNA
aaattcgagtctctatgg

SEQ ID NO: 69153 - DNA, 18 bp, synthetic construct
  source 1..18: mol_type = other DNA
aaattcgcctctctatcg

SEQ ID NO: 69154 - DNA, 18 bp, synthetic construct
  source 1..18: mol_type = other DNA
aaattcgtctgactatcg

SEQ ID NO: 69155 - DNA, 18 bp, synthetic construct
  source 1..18: mol_type = other DNA
aaattctattcactaaag

SEQ ID NO: 69156 - DNA, 18 bp, synthetic construct
  source 1..18: mol_type = other DNA
aaatttatcacactatgg

SEQ ID NO: 69157 - DNA, 18 bp, synthetic construct
  source 1..18: mol_type = other DNA
aacaacaactcactattg

SEQ ID NO: 69158 - DNA, 18 bp, synthetic construct
  source 1..18: mol_type = other DNA
aacaacagctcacaaaag

SEQ ID NO: 69159 - DNA, 18 bp, synthetic construct
  source 1..18: mol_type = other DNA
aacaacgtctcacaattg

SEQ ID NO: 69160 - DNA, 18 bp, synthetic construct
  source 1..18: mol_type = other DNA
aactaagactgactatcg

SEQ ID NO: 69161 - DNA, 18 bp, synthetic construct
  source 1..18: mol_type = other DNA
aactatgtctccctaaag

SEQ ID NO: 69162 - DNA, 18 bp, synthetic construct
  source 1..18: mol_type = other DNA
aactccgtctcataatag

SEQ ID NO: 69163 - DNA, 18 bp, synthetic construct
  source 1..18: mol_type = other DNA
aacttggaataactattg

SEQ ID NO: 69164 - DNA, 18 bp, synthetic construct
  source 1..18: mol_type = other DNA
aagaaatactcactatag

SEQ ID NO: 69165 - DNA, 18 bp, synthetic construct
  source 1..18: mol_type = other DNA
aagaacgacaagctatag

SEQ ID NO: 69166 - DNA, 18 bp, synthetic construct
  source 1..18: mol_type = other DNA
aagcacaactgtctatgg

SEQ ID NO: 69167 - DNA, 18 bp, synthetic construct
  source 1..18: mol_type = other DNA
aagcacaagacactatag

SEQ ID NO: 69168 - DNA, 18 bp, synthetic construct
  source 1..18: mol_type = other DNA
aagtacaagatactgaag

SEQ ID NO: 69169 - DNA, 18 bp, synthetic construct
  source 1..18: mol_type = other DNA
aagtccgactcactcaag

SEQ ID NO: 69170 - DNA, 18 bp, synthetic construct
  source 1..18: mol_type = other DNA
aagtgcttctctcagtag

SEQ ID NO: 69171 - DNA, 18 bp, synthetic construct
  source 1..18: mol_type = other DNA
aagttagcttcattattg

SEQ ID NO: 69172 - DNA, 18 bp, synthetic construct
  source 1..18: mol_type = other DNA
aagttcgactaactattg

SEQ ID NO: 69173 - DNA, 18 bp, synthetic construct
  source 1..18: mol_type = other DNA
aataacatctcattatcg

SEQ ID NO: 69174 - DNA, 18 bp, synthetic construct
  source 1..18: mol_type = other DNA
aataacgagtcagcatag

SEQ ID NO: 69175 - DNA, 18 bp, synthetic construct
  source 1..18: mol_type = other DNA
aataacgattgagaaaag

SEQ ID NO: 69176 - DNA, 18 bp, synthetic construct
  source 1..18: mol_type = other DNA
aataacgtgtcaaagttg

SEQ ID NO: 69177 - DNA, 18 bp, synthetic construct
  source 1..18: mol_type = other DNA
aataatgaccggttatag

SEQ ID NO: 69178 - DNA, 18 bp, synthetic construct
  source 1..18: mol_type = other DNA
aataccgacacattttag

SEQ ID NO: 69179 - DNA, 18 bp, synthetic construct
  source 1..18: mol_type = other DNA
aatagcgtctcactaaag

SEQ ID NO: 69180 - DNA, 18 bp, synthetic construct
  source 1..18: mol_type = other DNA
aatatcgactcactctag

SEQ ID NO: 69181 - DNA, 18 bp, synthetic construct
  source 1..18: mol_type = other DNA
aatcgcgactctctatag

SEQ ID NO: 69182 - DNA, 18 bp, synthetic construct
  source 1..18: mol_type = other DNA
aatgactaaacactaaag

SEQ ID NO: 69183 - DNA, 18 bp, synthetic construct
  source 1..18: mol_type = other DNA
aattacgaatcacagtag

SEQ ID NO: 69184 - DNA, 18 bp, synthetic construct
  source 1..18: mol_type = other DNA
aattacgacactctgtag

SEQ ID NO: 69185 - DNA, 18 bp, synthetic construct
  source 1..18: mol_type = other DNA
aattacgactaacattag

SEQ ID NO: 69186 - DNA, 18 bp, synthetic construct
  source 1..18: mol_type = other DNA
aattacgactctcttaag

SEQ ID NO: 69187 - DNA, 18 bp, synthetic construct
  source 1..18: mol_type = other DNA
aattacgtctcaccattg

SEQ ID NO: 69188 - DNA, 18 bp, synthetic construct
  source 1..18: mol_type = other DNA
aattaggactaaccatag

SEQ ID NO: 69189 - DNA, 18 bp, synthetic construct
  source 1..18: mol_type = other DNA
aattaggactctctttag

SEQ ID NO: 69190 - DNA, 18 bp, synthetic construct
  source 1..18: mol_type = other DNA
aattatgactttctacag

SEQ ID NO: 69191 - DNA, 18 bp, synthetic construct
  source 1..18: mol_type = other DNA
aattatgtctcacaaaag

SEQ ID NO: 69192 - DNA, 18 bp, synthetic construct
  source 1..18: mol_type = other DNA
aattattactcattatag

SEQ ID NO: 69193 - DNA, 18 bp, synthetic construct
  source 1..18: mol_type = other DNA
aatttcaactcacttttg

SEQ ID NO: 69194 - DNA, 18 bp, synthetic construct
  source 1..18: mol_type = other DNA
aatttccattcattatgg

SEQ ID NO: 69195 - DNA, 18 bp, synthetic construct
  source 1..18: mol_type = other DNA
aatttcgtcaaacgattg

SEQ ID NO: 69196 - DNA, 18 bp, synthetic construct
  source 1..18: mol_type = other DNA
acacacgtatcactatag

SEQ ID NO: 69197 - DNA, 18 bp, synthetic construct
  source 1..18: mol_type = other DNA
acactcttatcactatag

SEQ ID NO: 69198 - DNA, 18 bp, synthetic construct
  source 1..18: mol_type = other DNA
acatacaacacaccatag

SEQ ID NO: 69199 - DNA, 18 bp, synthetic construct
  source 1..18: mol_type = other DNA
acatacaacttcctatag

SEQ ID NO: 69200 - DNA, 18 bp, synthetic construct
  source 1..18: mol_type = other DNA
acatacctttctctatag

SEQ ID NO: 69201 - DNA, 18 bp, synthetic construct
  source 1..18: mol_type = other DNA
acatgctactcaatattg

SEQ ID NO: 69202 - DNA, 18 bp, synthetic construct
  source 1..18: mol_type = other DNA
acattagcctcactatag

SEQ ID NO: 69203 - DNA, 18 bp, synthetic construct
  source 1..18: mol_type = other DNA
acattcgattccattcag

SEQ ID NO: 69204 - DNA, 18 bp, synthetic construct
  source 1..18: mol_type = other DNA
acttaccactctcaatag

SEQ ID NO: 69205 - DNA, 18 bp, synthetic construct
  source 1..18: mol_type = other DNA
acttactaaacactttag

SEQ ID NO: 69206 - DNA, 18 bp, synthetic construct
  source 1..18: mol_type = other DNA
agaaacgactaacgtcag

SEQ ID NO: 69207 - DNA, 18 bp, synthetic construct
  source 1..18: mol_type = other DNA
agatacaactcacgctag

SEQ ID NO: 69208 - DNA, 18 bp, synthetic construct
  source 1..18: mol_type = other DNA
agattcggctaattatag

SEQ ID NO: 69209 - DNA, 18 bp, synthetic construct
  source 1..18: mol_type = other DNA
agctaggaatcaatatag

SEQ ID NO: 69210 - DNA, 18 bp, synthetic construct
  source 1..18: mol_type = other DNA
aggtaagacactctgtag

SEQ ID NO: 69211 - DNA, 18 bp, synthetic construct
  source 1..18: mol_type = other DNA
agttacgtctcactggag

SEQ ID NO: 69212 - DNA, 18 bp, synthetic construct
  source 1..18: mol_type = other DNA
ataaacgactagcaaaag

SEQ ID NO: 69213 - DNA, 18 bp, synthetic construct
  source 1..18: mol_type = other DNA
ataatacacaaactatag

SEQ ID NO: 69214 - DNA, 18 bp, synthetic construct
  source 1..18: mol_type = other DNA
ataatcgtctcactattg

SEQ ID NO: 69215 - DNA, 18 bp, synthetic construct
  source 1..18: mol_type = other DNA
atacacgacacgctaaag

SEQ ID NO: 69216 - DNA, 18 bp, synthetic construct
  source 1..18: mol_type = other DNA
atataaaactcactttcg

SEQ ID NO: 69217 - DNA, 18 bp, synthetic construct
  source 1..18: mol_type = other DNA
atataacactcactaacg

SEQ ID NO: 69218 - DNA, 18 bp, synthetic construct
  source 1..18: mol_type = other DNA
atataagattcactttag

SEQ ID NO: 69219 - DNA, 18 bp, synthetic construct
  source 1..18: mol_type = other DNA
atataagtctcagttcag

SEQ ID NO: 69220 - DNA, 18 bp, synthetic construct
  source 1..18: mol_type = other DNA
atataccattctctaatg

SEQ ID NO: 69221 - DNA, 18 bp, synthetic construct
  source 1..18: mol_type = other DNA
atatacgaaactctatag

SEQ ID NO: 69222 - DNA, 18 bp, synthetic construct
  source 1..18: mol_type = other DNA
atatacgacataatatag

SEQ ID NO: 69223 - DNA, 18 bp, synthetic construct
  source 1..18: mol_type = other DNA
atatacgactctcattag

SEQ ID NO: 69224 - DNA, 18 bp, synthetic construct
  source 1..18: mol_type = other DNA
atatacgacttaatttcg

SEQ ID NO: 69225 - DNA, 18 bp, synthetic construct
  source 1..18: mol_type = other DNA
atatacgatatgctatag

SEQ ID NO: 69226 - DNA, 18 bp, synthetic construct
  source 1..18: mol_type = other DNA
atatacgattcactaatg

SEQ ID NO: 69227 - DNA, 18 bp, synthetic construct
  source 1..18: mol_type = other DNA
atatacgattcatattag

SEQ ID NO: 69228 - DNA, 18 bp, synthetic construct
  source 1..18: mol_type = other DNA
atatacgattctcaaatg

SEQ ID NO: 69229 - DNA, 18 bp, synthetic construct
  source 1..18: mol_type = other DNA
atatacgcctcacaaaag

SEQ ID NO: 69230 - DNA, 18 bp, synthetic construct
  source 1..18: mol_type = other DNA
atatacgtctcattaaag

SEQ ID NO: 69231 - DNA, 18 bp, synthetic construct
  source 1..18: mol_type = other DNA
atatactatccactatcg

SEQ ID NO: 69232 - DNA, 18 bp, synthetic construct
  source 1..18: mol_type = other DNA
atatactattatctattg

SEQ ID NO: 69233 - DNA, 18 bp, synthetic construct
  source 1..18: mol_type = other DNA
atataggatacactattg

SEQ ID NO: 69234 - DNA, 18 bp, synthetic construct
  source 1..18: mol_type = other DNA
atatccgactcaattttg

SEQ ID NO: 69235 - DNA, 18 bp, synthetic construct
  source 1..18: mol_type = other DNA
atatgcgaatcactaaag

SEQ ID NO: 69236 - DNA, 18 bp, synthetic construct
  source 1..18: mol_type = other DNA
atatgctacacaataatg

SEQ ID NO: 69237 - DNA, 18 bp, synthetic construct
  source 1..18: mol_type = other DNA
atattcgatacactatag

SEQ ID NO: 69238 - DNA, 18 bp, synthetic construct
  source 1..18: mol_type = other DNA
atctacgactatctatag

SEQ ID NO: 69239 - DNA, 18 bp, synthetic construct
  source 1..18: mol_type = other DNA
atgaacgacacactaaag

SEQ ID NO: 69240 - DNA, 18 bp, synthetic construct
  source 1..18: mol_type = other DNA
attaacatctcactatag

SEQ ID NO: 69241 - DNA, 18 bp, synthetic construct
  source 1..18: mol_type = other DNA
attaacatctcgctattg

SEQ ID NO: 69242 - DNA, 18 bp, synthetic construct
  source 1..18: mol_type = other DNA
attaaccacacacaaaag

SEQ ID NO: 69243 - DNA, 18 bp, synthetic construct
  source 1..18: mol_type = other DNA
attcataacccacagtag

SEQ ID NO: 69244 - DNA, 18 bp, synthetic construct
  source 1..18: mol_type = other DNA
atttaccacataatattg

SEQ ID NO: 69245 - DNA, 18 bp, synthetic construct
  source 1..18: mol_type = other DNA
atttacgaccaactatag

SEQ ID NO: 69246 - DNA, 18 bp, synthetic construct
  source 1..18: mol_type = other DNA
atttacggctcccaaatg

SEQ ID NO: 69247 - DNA, 18 bp, synthetic construct
  source 1..18: mol_type = other DNA
atttatagctcatattag

SEQ ID NO: 69248 - DNA, 18 bp, synthetic construct
  source 1..18: mol_type = other DNA
attttcgattcactatag

SEQ ID NO: 69249 - DNA, 18 bp, synthetic construct
  source 1..18: mol_type = other DNA
caaaacgactttctaaag

SEQ ID NO: 69250 - DNA, 18 bp, synthetic construct
  source 1..18: mol_type = other DNA
caaaacggcacacaatag

SEQ ID NO: 69251 - DNA, 18 bp, synthetic construct
  source 1..18: mol_type = other DNA
caaaacgtttttcaacag

SEQ ID NO: 69252 - DNA, 18 bp, synthetic construct
  source 1..18: mol_type = other DNA
caaaactcctgcctattg

SEQ ID NO: 69253 - DNA, 18 bp, synthetic construct
  source 1..18: mol_type = other DNA
caaaaggacacaatatgg

SEQ ID NO: 69254 - DNA, 18 bp, synthetic construct
  source 1..18: mol_type = other DNA
caaaccgactcactcttg

SEQ ID NO: 69255 - DNA, 18 bp, synthetic construct
  source 1..18: mol_type = other DNA
caacactacttactttag

SEQ ID NO: 69256 - DNA, 18 bp, synthetic construct
  source 1..18: mol_type = other DNA
caataaatcttacaatag

SEQ ID NO: 69257 - DNA, 18 bp, synthetic construct
  source 1..18: mol_type = other DNA
caataagacaccttttag

SEQ ID NO: 69258 - DNA, 18 bp, synthetic construct
  source 1..18: mol_type = other DNA
caataccgctcaatttag

SEQ ID NO: 69259 - DNA, 18 bp, synthetic construct
  source 1..18: mol_type = other DNA
caatacctctcgaaatag

SEQ ID NO: 69260 - DNA, 18 bp, synthetic construct
  source 1..18: mol_type = other DNA
caatacgaaacacaaaag

SEQ ID NO: 69261 - DNA, 18 bp, synthetic construct
  source 1..18: mol_type = other DNA
caatacgacgctcttttg

SEQ ID NO: 69262 - DNA, 18 bp, synthetic construct
  source 1..18: mol_type = other DNA
caatacgactcatccagg

SEQ ID NO: 69263 - DNA, 18 bp, synthetic construct
  source 1..18: mol_type = other DNA
caatacgatacactgtcg

SEQ ID NO: 69264 - DNA, 18 bp, synthetic construct
  source 1..18: mol_type = other DNA
caatacgtctcacttatg

SEQ ID NO: 69265 - DNA, 18 bp, synthetic construct
  source 1..18: mol_type = other DNA
caatacgtctctcaattg

SEQ ID NO: 69266 - DNA, 18 bp, synthetic construct
  source 1..18: mol_type = other DNA
caatacttccttctatag

SEQ ID NO: 69267 - DNA, 18 bp, synthetic construct
  source 1..18: mol_type = other DNA
caatatctcttactattg

SEQ ID NO: 69268 - DNA, 18 bp, synthetic construct
  source 1..18: mol_type = other DNA
caatccgtttctcaatgg

SEQ ID NO: 69269 - DNA, 18 bp, synthetic construct
  source 1..18: mol_type = other DNA
caatgcgtcccactaaag

SEQ ID NO: 69270 - DNA, 18 bp, synthetic construct
  source 1..18: mol_type = other DNA
caatgcgtcctactatag

SEQ ID NO: 69271 - DNA, 18 bp, synthetic construct
  source 1..18: mol_type = other DNA
caattactctcactatag

SEQ ID NO: 69272 - DNA, 18 bp, synthetic construct
  source 1..18: mol_type = other DNA
caattcgatccaccatag

SEQ ID NO: 69273 - DNA, 18 bp, synthetic construct
  source 1..18: mol_type = other DNA
caattcggcaaataaaag

SEQ ID NO: 69274 - DNA, 18 bp, synthetic construct
  source 1..18: mol_type = other DNA
caattctagatactatag

SEQ ID NO: 69275 - DNA, 18 bp, synthetic construct
  source 1..18: mol_type = other DNA
caatttaattcactatag

SEQ ID NO: 69276 - DNA, 18 bp, synthetic construct
  source 1..18: mol_type = other DNA
cacaaccactcgcaattg

SEQ ID NO: 69277 - DNA, 18 bp, synthetic construct
  source 1..18: mol_type = other DNA
cactaccactcgcatcag

SEQ ID NO: 69278 - DNA, 18 bp, synthetic construct
  source 1..18: mol_type = other DNA
cactacgaaacactattg

SEQ ID NO: 69279 - DNA, 18 bp, synthetic construct
  source 1..18: mol_type = other DNA
cactccgactccctattg

SEQ ID NO: 69280 - DNA, 18 bp, synthetic construct
  source 1..18: mol_type = other DNA
caggaggaatcaccaacg

SEQ ID NO: 69281 - DNA, 18 bp, synthetic construct
  source 1..18: mol_type = other DNA
catcacgaataactttag

SEQ ID NO: 69282 - DNA, 18 bp, synthetic construct
  source 1..18: mol_type = other DNA
catcaggtcccactatag

SEQ ID NO: 69283 - DNA, 18 bp, synthetic construct
  source 1..18: mol_type = other DNA
cattacgtcatatcatgg

SEQ ID NO: 69284 - DNA, 18 bp, synthetic construct
  source 1..18: mol_type = other DNA
cattcctactcactccag

SEQ ID NO: 69285 - DNA, 18 bp, synthetic construct
  source 1..18: mol_type = other DNA
catttcgaatcactaaag

SEQ ID NO: 69286 - DNA, 18 bp, synthetic construct
  source 1..18: mol_type = other DNA
catttcgacacagtatag

SEQ ID NO: 69287 - DNA, 18 bp, synthetic construct
  source 1..18: mol_type = other DNA
ccaaacgtcccaataaag

SEQ ID NO: 69288 - DNA, 18 bp, synthetic construct
  source 1..18: mol_type = other DNA
ccatccaattctcaatag

SEQ ID NO: 69289 - DNA, 18 bp, synthetic construct
  source 1..18: mol_type = other DNA
cgatacaacacacaatag

SEQ ID NO: 69290 - DNA, 18 bp, synthetic construct
  source 1..18: mol_type = other DNA
cgatatggcttggtccgg

SEQ ID NO: 69291 - DNA, 18 bp, synthetic construct
  source 1..18: mol_type = other DNA
cgattcgactcaatacag

SEQ ID NO: 69292 - DNA, 18 bp, synthetic construct
  source 1..18: mol_type = other DNA
cgattgaaatcactatag

SEQ ID NO: 69293 - DNA, 18 bp, synthetic construct
  source 1..18: mol_type = other DNA
ctaaaccacacacttcag

SEQ ID NO: 69294 - DNA, 18 bp, synthetic construct
  source 1..18: mol_type = other DNA
ctaaacgtctcacaatcg

SEQ ID NO: 69295 - DNA, 18 bp, synthetic construct
  source 1..18: mol_type = other DNA
ctaaactacacactatag

SEQ ID NO: 69296 - DNA, 18 bp, synthetic construct
  source 1..18: mol_type = other DNA
ctagacgactttctattg

SEQ ID NO: 69297 - DNA, 18 bp, synthetic construct
  source 1..18: mol_type = other DNA
ctataagacacaccatag

SEQ ID NO: 69298 - DNA, 18 bp, synthetic construct
  source 1..18: mol_type = other DNA
ctatacgacacacttaag

SEQ ID NO: 69299 - DNA, 18 bp, synthetic construct
  source 1..18: mol_type = other DNA
ctatacgactcaatcttg

SEQ ID NO: 69300 - DNA, 18 bp, synthetic construct
  source 1..18: mol_type = other DNA
ctatacgactcgctaatg

SEQ ID NO: 69301 - DNA, 18 bp, synthetic construct
  source 1..18: mol_type = other DNA
ctatacgattctataatg

SEQ ID NO: 69302 - DNA, 18 bp, synthetic construct
  source 1..18: mol_type = other DNA
ctatacgtctgacttaag

SEQ ID NO: 69303 - DNA, 18 bp, synthetic construct
  source 1..18: mol_type = other DNA
ctatagcattatctatag

SEQ ID NO: 69304 - DNA, 18 bp, synthetic construct
  source 1..18: mol_type = other DNA
ctatttaacacactatag

SEQ ID NO: 69305 - DNA, 18 bp, synthetic construct
  source 1..18: mol_type = other DNA
ctgtgcgattcaataaag

SEQ ID NO: 69306 - DNA, 18 bp, synthetic construct
  source 1..18: mol_type = other DNA
ctgtgggactcactatag

SEQ ID NO: 69307 - DNA, 18 bp, synthetic construct
  source 1..18: mol_type = other DNA
cttaacgtttcacttttg

SEQ ID NO: 69308 - DNA, 18 bp, synthetic construct
  source 1..18: mol_type = other DNA
ctttccgactctataacg

SEQ ID NO: 69309 - DNA, 18 bp, synthetic construct
  source 1..18: mol_type = other DNA
gaaatcatctcactatag

SEQ ID NO: 69310 - DNA, 18 bp, synthetic construct
  source 1..18: mol_type = other DNA
gaacacgacctgctatag

SEQ ID NO: 69311 - DNA, 18 bp, synthetic construct
  source 1..18: mol_type = other DNA
gaacgtgactcacattag

SEQ ID NO: 69312 - DNA, 18 bp, synthetic construct
  source 1..18: mol_type = other DNA
gaactcgtcactcaattg

SEQ ID NO: 69313 - DNA, 18 bp, synthetic construct
  source 1..18: mol_type = other DNA
gaataaaatacactattg

SEQ ID NO: 69314 - DNA, 18 bp, synthetic construct
  source 1..18: mol_type = other DNA
gaatacctctccttacag

SEQ ID NO: 69315 - DNA, 18 bp, synthetic construct
  source 1..18: mol_type = other DNA
gaatgctactcatttttg

SEQ ID NO: 69316 - DNA, 18 bp, synthetic construct
  source 1..18: mol_type = other DNA
gatttcgactcacttgag

SEQ ID NO: 69317 - DNA, 18 bp, synthetic construct
  source 1..18: mol_type = other DNA
gcaaacgactgactattg

SEQ ID NO: 69318 - DNA, 18 bp, synthetic construct
  source 1..18: mol_type = other DNA
gcttgcgactcattaaag

SEQ ID NO: 69319 - DNA, 18 bp, synthetic construct
  source 1..18: mol_type = other DNA
gtacacgactcaatcatg

SEQ ID NO: 69320 - DNA, 18 bp, synthetic construct
  source 1..18: mol_type = other DNA
gtatacgaatctttatag

SEQ ID NO: 69321 - DNA, 18 bp, synthetic construct
  source 1..18: mol_type = other DNA
gtatacgactatcaatag

SEQ ID NO: 69322 - DNA, 18 bp, synthetic construct
  source 1..18: mol_type = other DNA
taaaaacacttagtaatg

SEQ ID NO: 69323 - DNA, 18 bp, synthetic construct
  source 1..18: mol_type = other DNA
taaaaagaatcactaatg

SEQ ID NO: 69324 - DNA, 18 bp, synthetic construct
  source 1..18: mol_type = other DNA
taaaaagactgacctaag

SEQ ID NO: 69325 - DNA, 18 bp, synthetic construct
  source 1..18: mol_type = other DNA
taaaaagactttcaaaag

SEQ ID NO: 69326 - DNA, 18 bp, synthetic construct
  source 1..18: mol_type = other DNA
taaaaagatacaccatag

SEQ ID NO: 69327 - DNA, 18 bp, synthetic construct
  source 1..18: mol_type = other DNA
taaaacaaccctcaatag

SEQ ID NO: 69328 - DNA, 18 bp, synthetic construct
  source 1..18: mol_type = other DNA
taaaacaactaaccattg

SEQ ID NO: 69329 - DNA, 18 bp, synthetic construct
  source 1..18: mol_type = other DNA
taaaacaactcgattaag

SEQ ID NO: 69330 - DNA, 18 bp, synthetic construct
  source 1..18: mol_type = other DNA
taaaacaattcactgtcg

SEQ ID NO: 69331 - DNA, 18 bp, synthetic construct
  source 1..18: mol_type = other DNA
taaaacccatcaataaag

SEQ ID NO: 69332 - DNA, 18 bp, synthetic construct
  source 1..18: mol_type = other DNA
taaaacgaaccaccattg

SEQ ID NO: 69333 - DNA, 18 bp, synthetic construct
  source 1..18: mol_type = other DNA
taaaacgacatacttttg

SEQ ID NO: 69334 - DNA, 18 bp, synthetic construct
  source 1..18: mol_type = other DNA
taaaacgacgctcaatcg

SEQ ID NO: 69335 - DNA, 18 bp, synthetic construct
  source 1..18: mol_type = other DNA
taaaacgactcgccaatg

SEQ ID NO: 69336 - DNA, 18 bp, synthetic construct
  source 1..18: mol_type = other DNA
taaaacgattcaacattg

SEQ ID NO: 69337 - DNA, 18 bp, synthetic construct
  source 1..18: mol_type = other DNA
taaaacgatttaccaatg

SEQ ID NO: 69338 - DNA, 18 bp, synthetic construct
  source 1..18: mol_type = other DNA
taaaacgcccctttatag

SEQ ID NO: 69339 - DNA, 18 bp, synthetic construct
  source 1..18: mol_type = other DNA
taaaacggatcacttaag

SEQ ID NO: 69340 - DNA, 18 bp, synthetic construct
  source 1..18: mol_type = other DNA
taaaacggatcgctattg

SEQ ID NO: 69341 - DNA, 18 bp, synthetic construct
  source 1..18: mol_type = other DNA
taaaacgtcagtcactag

SEQ ID NO: 69342 - DNA, 18 bp, synthetic construct
  source 1..18: mol_type = other DNA
taaaacgtccaactagag

SEQ ID NO: 69343 - DNA, 18 bp, synthetic construct
  source 1..18: mol_type = other DNA
taaaacgtcgctccatag

SEQ ID NO: 69344 - DNA, 18 bp, synthetic construct
  source 1..18: mol_type = other DNA
taaaacgtctaacaagag

SEQ ID NO: 69345 - DNA, 18 bp, synthetic construct
  source 1..18: mol_type = other DNA
taaaactacacacttcag

SEQ ID NO: 69346 - DNA, 18 bp, synthetic construct
  source 1..18: mol_type = other DNA
taaaactactcacaaacg

SEQ ID NO: 69347 - DNA, 18 bp, synthetic construct
  source 1..18: mol_type = other DNA
taaaactcctcgccatag

SEQ ID NO: 69348 - DNA, 18 bp, synthetic construct
  source 1..18: mol_type = other DNA
taaaacttcccaatatag

SEQ ID NO: 69349 - DNA, 18 bp, synthetic construct
  source 1..18: mol_type = other DNA
taaaacttttcactaaag

SEQ ID NO: 69350 - DNA, 18 bp, synthetic construct
  source 1..18: mol_type = other DNA
taaaatgatttactgtag

SEQ ID NO: 69351 - DNA, 18 bp, synthetic construct
  source 1..18: mol_type = other DNA
taaaccaactcactcaag

SEQ ID NO: 69352 - DNA, 18 bp, synthetic construct
  source 1..18: mol_type = other DNA
taaaccgaaaaactagag

SEQ ID NO: 69353 - DNA, 18 bp, synthetic construct
  source 1..18: mol_type = other DNA
taaaccgacacacttaag

SEQ ID NO: 69354 - DNA, 18 bp, synthetic construct
  source 1..18: mol_type = other DNA
taaacctacacactattg

SEQ ID NO: 69355 - DNA, 18 bp, synthetic construct
  source 1..18: mol_type = other DNA
taaacggactgattatag

SEQ ID NO: 69356 - DNA, 18 bp, synthetic construct
  source 1..18: mol_type = other DNA
taaacggacttcctgtag

SEQ ID NO: 69357 - DNA, 18 bp, synthetic construct
  source 1..18: mol_type = other DNA
taaagcgtctctcaacag

SEQ ID NO: 69358 - DNA, 18 bp, synthetic construct
  source 1..18: mol_type = other DNA
taaagcgttttactatag

SEQ ID NO: 69359 - DNA, 18 bp, synthetic construct
  source 1..18: mol_type = other DNA
taaagtgactcgctacag

SEQ ID NO: 69360 - DNA, 18 bp, synthetic construct
  source 1..18: mol_type = other DNA
taaatcaactaactaatg

SEQ ID NO: 69361 - DNA, 18 bp, synthetic construct
  source 1..18: mol_type = other DNA
taaatcatctcactaaag

SEQ ID NO: 69362 - DNA, 18 bp, synthetic construct
  source 1..18: mol_type = other DNA
taaatcgactcacaaatg

SEQ ID NO: 69363 - DNA, 18 bp, synthetic construct
  source 1..18: mol_type = other DNA
taaatcgactctttattg

SEQ ID NO: 69364 - DNA, 18 bp, synthetic construct
  source 1..18: mol_type = other DNA
taaatcgatccaatatag

SEQ ID NO: 69365 - DNA, 18 bp, synthetic construct
  source 1..18: mol_type = other DNA
taaatcgtcacacaatag

SEQ ID NO: 69366 - DNA, 18 bp, synthetic construct
  source 1..18: mol_type = other DNA
taaatcgtctcactaagg

SEQ ID NO: 69367 - DNA, 18 bp, synthetic construct
  source 1..18: mol_type = other DNA
taaatcgtctctctattg

SEQ ID NO: 69368 - DNA, 18 bp, synthetic construct
  source 1..18: mol_type = other DNA
taaatcttctctctttag

SEQ ID NO: 69369 - DNA, 18 bp, synthetic construct
  source 1..18: mol_type = other DNA
taaatggactaactattg

SEQ ID NO: 69370 - DNA, 18 bp, synthetic construct
  source 1..18: mol_type = other DNA
taaattgactcataatag

SEQ ID NO: 69371 - DNA, 18 bp, synthetic construct
  source 1..18: mol_type = other DNA
taacaagaatcactggag

SEQ ID NO: 69372 - DNA, 18 bp, synthetic construct
  source 1..18: mol_type = other DNA
taacaagactctgtttag

SEQ ID NO: 69373 - DNA, 18 bp, synthetic construct
  source 1..18: mol_type = other DNA
taacaatcctcactcaag

SEQ ID NO: 69374 - DNA, 18 bp, synthetic construct
  source 1..18: mol_type = other DNA
taacacatcacacgatcg

SEQ ID NO: 69375 - DNA, 18 bp, synthetic construct
  source 1..18: mol_type = other DNA
taacacgacacaatgttg

SEQ ID NO: 69376 - DNA, 18 bp, synthetic construct
  source 1..18: mol_type = other DNA
taacacgagaatataatg

SEQ ID NO: 69377 - DNA, 18 bp, synthetic construct
  source 1..18: mol_type = other DNA
taacacgatacctaatgg

SEQ ID NO: 69378 - DNA, 18 bp, synthetic construct
  source 1..18: mol_type = other DNA
taacacgtctttctttag

SEQ ID NO: 69379 - DNA, 18 bp, synthetic construct
  source 1..18: mol_type = other DNA
taacactactcaatacgg

SEQ ID NO: 69380 - DNA, 18 bp, synthetic construct
  source 1..18: mol_type = other DNA
taacagtcctctcaatag

SEQ ID NO: 69381 - DNA, 18 bp, synthetic construct
  source 1..18: mol_type = other DNA
taacatacatgattacag

SEQ ID NO: 69382 - DNA, 18 bp, synthetic construct
  source 1..18: mol_type = other DNA
taacatgattctctattg

SEQ ID NO: 69383 - DNA, 18 bp, synthetic construct
  source 1..18: mol_type = other DNA
taaccggattccgcatag

SEQ ID NO: 69384 - DNA, 18 bp, synthetic construct
  source 1..18: mol_type = other DNA
taacgcgactctgtaatg

SEQ ID NO: 69385 - DNA, 18 bp, synthetic construct
  source 1..18: mol_type = other DNA
taactccactaactgaag

SEQ ID NO: 69386 - DNA, 18 bp, synthetic construct
  source 1..18: mol_type = other DNA
taactcgactctcactag

SEQ ID NO: 69387 - DNA, 18 bp, synthetic construct
  source 1..18: mol_type = other DNA
taactcgatttactaaag

SEQ ID NO: 69388 - DNA, 18 bp, synthetic construct
  source 1..18: mol_type = other DNA
taactcgcccctccatgg

SEQ ID NO: 69389 - DNA, 18 bp, synthetic construct
  source 1..18: mol_type = other DNA
taactcgcctgaattatg

SEQ ID NO: 69390 - DNA, 18 bp, synthetic construct
  source 1..18: mol_type = other DNA
taactctaaacactatag

SEQ ID NO: 69391 - DNA, 18 bp, synthetic construct
  source 1..18: mol_type = other DNA
taactctacgcacaattg

SEQ ID NO: 69392 - DNA, 18 bp, synthetic construct
  source 1..18: mol_type = other DNA
taactctacgcactattg

SEQ ID NO: 69393 - DNA, 18 bp, synthetic construct
  source 1..18: mol_type = other DNA
taactggactttcattag

SEQ ID NO: 69394 - DNA, 18 bp, synthetic construct
  source 1..18: mol_type = other DNA
taacttgactgtctagag

SEQ ID NO: 69395 - DNA, 18 bp, synthetic construct
  source 1..18: mol_type = other DNA
taacttgtcacacatgcg

SEQ ID NO: 69396 - DNA, 18 bp, synthetic construct
  source 1..18: mol_type = other DNA
taagaagtcacaattttg

SEQ ID NO: 69397 - DNA, 18 bp, synthetic construct
  source 1..18: mol_type = other DNA
taagacgacgatctacag

SEQ ID NO: 69398 - DNA, 18 bp, synthetic construct
  source 1..18: mol_type = other DNA
taagacgtttctcgaaag

SEQ ID NO: 69399 - DNA, 18 bp, synthetic construct
  source 1..18: mol_type = other DNA
taagactactctcttaag

SEQ ID NO: 69400 - DNA, 18 bp, synthetic construct
  source 1..18: mol_type = other DNA
taagatgcctccaaatag

SEQ ID NO: 69401 - DNA, 18 bp, synthetic construct
  source 1..18: mol_type = other DNA
taagccaaatcacaaaag

SEQ ID NO: 69402 - DNA, 18 bp, synthetic construct
  source 1..18: mol_type = other DNA
taataaaatccacgatag

SEQ ID NO: 69403 - DNA, 18 bp, synthetic construct
  source 1..18: mol_type = other DNA
taataaaattcacttttg

SEQ ID NO: 69404 - DNA, 18 bp, synthetic construct
  source 1..18: mol_type = other DNA
taataagaataactagtg

SEQ ID NO: 69405 - DNA, 18 bp, synthetic construct
  source 1..18: mol_type = other DNA
taataagcctaacttttg

SEQ ID NO: 69406 - DNA, 18 bp, synthetic construct
  source 1..18: mol_type = other DNA
taataaggctcctcatag

SEQ ID NO: 69407 - DNA, 18 bp, synthetic construct
  source 1..18: mol_type = other DNA
taataagtcactctacag

SEQ ID NO: 69408 - DNA, 18 bp, synthetic construct
  source 1..18: mol_type = other DNA
taataatacattctatcg

SEQ ID NO: 69409 - DNA, 18 bp, synthetic construct
  source 1..18: mol_type = other DNA
taatacaaatcacaaatg

SEQ ID NO: 69410 - DNA, 18 bp, synthetic construct
  source 1..18: mol_type = other DNA
taatacaacaatttatag

SEQ ID NO: 69411 - DNA, 18 bp, synthetic construct
  source 1..18: mol_type = other DNA
taatacaacatcttttag

SEQ ID NO: 69412 - DNA, 18 bp, synthetic construct
  source 1..18: mol_type = other DNA
taatacaactcttttaag

SEQ ID NO: 69413 - DNA, 18 bp, synthetic construct
  source 1..18: mol_type = other DNA
taatacaactttctatca

SEQ ID NO: 69414 - DNA, 18 bp, synthetic construct
  source 1..18: mol_type = other DNA
taatacaattcatattag

SEQ ID NO: 69415 - DNA, 18 bp, synthetic construct
  source 1..18: mol_type = other DNA
taatacacgtccttatag

SEQ ID NO: 69416 - DNA, 18 bp, synthetic construct
  source 1..18: mol_type = other DNA
taatacatcactcaattg

SEQ ID NO: 69417 - DNA, 18 bp, synthetic construct
  source 1..18: mol_type = other DNA
taatacatttctctgtag

SEQ ID NO: 69418 - DNA, 18 bp, synthetic construct
  source 1..18: mol_type = other DNA
taataccaaacacattag

SEQ ID NO: 69419 - DNA, 18 bp, synthetic construct
  source 1..18: mol_type = other DNA
taataccacactcattag

SEQ ID NO: 69420 - DNA, 18 bp, synthetic construct
  source 1..18: mol_type = other DNA
taataccactctcataag

SEQ ID NO: 69421 - DNA, 18 bp, synthetic construct
  source 1..18: mol_type = other DNA
taataccactctcttatg

SEQ ID NO: 69422 - DNA, 18 bp, synthetic construct
  source 1..18: mol_type = other DNA
taataccgctcgcaattg

SEQ ID NO: 69423 - DNA, 18 bp, synthetic construct
  source 1..18: mol_type = other DNA
taatacctctcaaatcag

SEQ ID NO: 69424 - DNA, 18 bp, synthetic construct
  source 1..18: mol_type = other DNA
taatacctttcaccattg

SEQ ID NO: 69425 - DNA, 18 bp, synthetic construct
  source 1..18: mol_type = other DNA
taatacgaacatcttcag

SEQ ID NO: 69426 - DNA, 18 bp, synthetic construct
  source 1..18: mol_type = other DNA
taatacgaagctcctaag

SEQ ID NO: 69427 - DNA, 18 bp, synthetic construct
  source 1..18: mol_type = other DNA
taatacgaatcttcaatg

SEQ ID NO: 69428 - DNA, 18 bp, synthetic construct
  source 1..18: mol_type = other DNA
taatacgaattatttcag

SEQ ID NO: 69429 - DNA, 18 bp, synthetic construct
  source 1..18: mol_type = other DNA
taatacgacactaaatgg

SEQ ID NO: 69430 - DNA, 18 bp, synthetic construct
  source 1..18: mol_type = other DNA
taatacgacactccaatg

SEQ ID NO: 69431 - DNA, 18 bp, synthetic construct
  source 1..18: mol_type = other DNA
taatacgacatatttttg

SEQ ID NO: 69432 - DNA, 18 bp, synthetic construct
  source 1..18: mol_type = other DNA
taatacgacctacatacg

SEQ ID NO: 69433 - DNA, 18 bp, synthetic construct
  source 1..18: mol_type = other DNA
taatacgactagcatcaa

SEQ ID NO: 69434 - DNA, 18 bp, synthetic construct
  source 1..18: mol_type = other DNA
taatacgatccgcaatgg

SEQ ID NO: 69435 - DNA, 18 bp, synthetic construct
  source 1..18: mol_type = other DNA
taatacgccccagtgttg

SEQ ID NO: 69436 - DNA, 18 bp, synthetic construct
  source 1..18: mol_type = other DNA
taatacgccttagcattg

SEQ ID NO: 69437 - DNA, 18 bp, synthetic construct
  source 1..18: mol_type = other DNA
taatacggctgaaagtgg

SEQ ID NO: 69438 - DNA, 18 bp, synthetic construct
  source 1..18: mol_type = other DNA
taatacgtaacacactag

SEQ ID NO: 69439 - DNA, 18 bp, synthetic construct
  source 1..18: mol_type = other DNA
taatacgtacatctatag

SEQ ID NO: 69440 - DNA, 18 bp, synthetic construct
  source 1..18: mol_type = other DNA
taatacgtatggcaaaag

SEQ ID NO: 69441 - DNA, 18 bp, synthetic construct
  source 1..18: mol_type = other DNA
taatacgtcagtttatag

SEQ ID NO: 69442 - DNA, 18 bp, synthetic construct
  source 1..18: mol_type = other DNA
taatacgtctcataactg

SEQ ID NO: 69443 - DNA, 18 bp, synthetic construct
  source 1..18: mol_type = other DNA
taatacgtttctctgcag

SEQ ID NO: 69444 - DNA, 18 bp, synthetic construct
  source 1..18: mol_type = other DNA
taatacgtttttctgttg

SEQ ID NO: 69445 - DNA, 18 bp, synthetic construct
  source 1..18: mol_type = other DNA
taatactaatgactaacg

SEQ ID NO: 69446 - DNA, 18 bp, synthetic construct
  source 1..18: mol_type = other DNA
taatactacgcagtgatg

SEQ ID NO: 69447 - DNA, 18 bp, synthetic construct
  source 1..18: mol_type = other DNA
taatactactcaaagaag

SEQ ID NO: 69448 - DNA, 18 bp, synthetic construct
  source 1..18: mol_type = other DNA
taatactataggctatag

SEQ ID NO: 69449 - DNA, 18 bp, synthetic construct
  source 1..18: mol_type = other DNA
taatactctccttaatag

SEQ ID NO: 69450 - DNA, 18 bp, synthetic construct
  source 1..18: mol_type = other DNA
taatacttatcacaattg

SEQ ID NO: 69451 - DNA, 18 bp, synthetic construct
  source 1..18: mol_type = other DNA
taatacttcatactaaag

SEQ ID NO: 69452 - DNA, 18 bp, synthetic construct
  source 1..18: mol_type = other DNA
taatacttctccctcaag

SEQ ID NO: 69453 - DNA, 18 bp, synthetic construct
  source 1..18: mol_type = other DNA
taatacttctctttaaag

SEQ ID NO: 69454 - DNA, 18 bp, synthetic construct
  source 1..18: mol_type = other DNA
taatacttctgacctgag

SEQ ID NO: 69455 - DNA, 18 bp, synthetic construct
  source 1..18: mol_type = other DNA
taatacttcttcctttag

SEQ ID NO: 69456 - DNA, 18 bp, synthetic construct
  source 1..18: mol_type = other DNA
taatacttctttgtatag

SEQ ID NO: 69457 - DNA, 18 bp, synthetic construct
  source 1..18: mol_type = other DNA
taatagcactaacgaaag

SEQ ID NO: 69458 - DNA, 18 bp, synthetic construct
  source 1..18: mol_type = other DNA
taataggaaactctattg

SEQ ID NO: 69459 - DNA, 18 bp, synthetic construct
  source 1..18: mol_type = other DNA
taataggacactcgatgg

SEQ ID NO: 69460 - DNA, 18 bp, synthetic construct
  source 1..18: mol_type = other DNA
taataggactcaattctg

SEQ ID NO: 69461 - DNA, 18 bp, synthetic construct
  source 1..18: mol_type = other DNA
taataggtctgtctataa

SEQ ID NO: 69462 - DNA, 18 bp, synthetic construct
  source 1..18: mol_type = other DNA
taataggtcttactcccg

SEQ ID NO: 69463 - DNA, 18 bp, synthetic construct
  source 1..18: mol_type = other DNA
taatagtgctcgctgtag

SEQ ID NO: 69464 - DNA, 18 bp, synthetic construct
  source 1..18: mol_type = other DNA
taatatctctcacattag

SEQ ID NO: 69465 - DNA, 18 bp, synthetic construct
  source 1..18: mol_type = other DNA
taatatgacgctcagttg

SEQ ID NO: 69466 - DNA, 18 bp, synthetic construct
  source 1..18: mol_type = other DNA
taatatgattagctttag

SEQ ID NO: 69467 - DNA, 18 bp, synthetic construct
  source 1..18: mol_type = other DNA
taatatgatttactttcg

SEQ ID NO: 69468 - DNA, 18 bp, synthetic construct
  source 1..18: mol_type = other DNA
taatatgccatgcaatag

SEQ ID NO: 69469 - DNA, 18 bp, synthetic construct
  source 1..18: mol_type = other DNA
taatatgtcaaacattag

SEQ ID NO: 69470 - DNA, 18 bp, synthetic construct
  source 1..18: mol_type = other DNA
taatatgtctccatttag

SEQ ID NO: 69471 - DNA, 18 bp, synthetic construct
  source 1..18: mol_type = other DNA
taatatgtctctctcttg

SEQ ID NO: 69472 - DNA, 18 bp, synthetic construct
  source 1..18: mol_type = other DNA
taatattactcaaaatgg

SEQ ID NO: 69473 - DNA, 18 bp, synthetic construct
  source 1..18: mol_type = other DNA
taatattccttgctttag

SEQ ID NO: 69474 - DNA, 18 bp, synthetic construct
  source 1..18: mol_type = other DNA
taatcagactcccattag

SEQ ID NO: 69475 - DNA, 18 bp, synthetic construct
  source 1..18: mol_type = other DNA
taatcagtcacactttag

SEQ ID NO: 69476 - DNA, 18 bp, synthetic construct
  source 1..18: mol_type = other DNA
taatcataatcgctatag

SEQ ID NO: 69477 - DNA, 18 bp, synthetic construct
  source 1..18: mol_type = other DNA
taatccgaacgacgatag

SEQ ID NO: 69478 - DNA, 18 bp, synthetic construct
  source 1..18: mol_type = other DNA
taatccgactcagattcg

SEQ ID NO: 69479 - DNA, 18 bp, synthetic construct
  source 1..18: mol_type = other DNA
taatccgagatacgaaag

SEQ ID NO: 69480 - DNA, 18 bp, synthetic construct
  source 1..18: mol_type = other DNA
taatccgtctcaataacg

SEQ ID NO: 69481 - DNA, 18 bp, synthetic construct
  source 1..18: mol_type = other DNA
taatctcaatcccaatag

SEQ ID NO: 69482 - DNA, 18 bp, synthetic construct
  source 1..18: mol_type = other DNA
taatcttactcgccatag

SEQ ID NO: 69483 - DNA, 18 bp, synthetic construct
  source 1..18: mol_type = other DNA
taatgagactcttttaag

SEQ ID NO: 69484 - DNA, 18 bp, synthetic construct
  source 1..18: mol_type = other DNA
taatgcaaccaactattg

SEQ ID NO: 69485 - DNA, 18 bp, synthetic construct
  source 1..18: mol_type = other DNA
taatgcagctctctattg

SEQ ID NO: 69486 - DNA, 18 bp, synthetic construct
  source 1..18: mol_type = other DNA
taatgccttccattatag

SEQ ID NO: 69487 - DNA, 18 bp, synthetic construct
  source 1..18: mol_type = other DNA
taatgcgactaattactg

SEQ ID NO: 69488 - DNA, 18 bp, synthetic construct
  source 1..18: mol_type = other DNA
taatgcgagacacttttg

SEQ ID NO: 69489 - DNA, 18 bp, synthetic construct
  source 1..18: mol_type = other DNA
taatgcgattctttaaag

SEQ ID NO: 69490 - DNA, 18 bp, synthetic construct
  source 1..18: mol_type = other DNA
taatggaatttactatag

SEQ ID NO: 69491 - DNA, 18 bp, synthetic construct
  source 1..18: mol_type = other DNA
taattaaactcgatatag

SEQ ID NO: 69492 - DNA, 18 bp, synthetic construct
  source 1..18: mol_type = other DNA
taattcaaatctatattg

SEQ ID NO: 69493 - DNA, 18 bp, synthetic construct
  source 1..18: mol_type = other DNA
taattcaacagacgatag

SEQ ID NO: 69494 - DNA, 18 bp, synthetic construct
  source 1..18: mol_type = other DNA
taattcaacttgctagag

SEQ ID NO: 69495 - DNA, 18 bp, synthetic construct
  source 1..18: mol_type = other DNA
taattcaatttaatattg

SEQ ID NO: 69496 - DNA, 18 bp, synthetic construct
  source 1..18: mol_type = other DNA
taattcatctctctctag

SEQ ID NO: 69497 - DNA, 18 bp, synthetic construct
  source 1..18: mol_type = other DNA
taattccaaccagtatag

SEQ ID NO: 69498 - DNA, 18 bp, synthetic construct
  source 1..18: mol_type = other DNA
taattcgaactttattag

SEQ ID NO: 69499 - DNA, 18 bp, synthetic construct
  source 1..18: mol_type = other DNA
taattcgaatctcaattg

SEQ ID NO: 69500 - DNA, 18 bp, synthetic construct
  source 1..18: mol_type = other DNA
taattcgaattacaacag

SEQ ID NO: 69501 - DNA, 18 bp, synthetic construct
  source 1..18: mol_type = other DNA
taattcgacactttattg

SEQ ID NO: 69502 - DNA, 18 bp, synthetic construct
  source 1..18: mol_type = other DNA
taattcgactaagaaaag

SEQ ID NO: 69503 - DNA, 18 bp, synthetic construct
  source 1..18: mol_type = other DNA
taattcgagatactgtag

SEQ ID NO: 69504 - DNA, 18 bp, synthetic construct
  source 1..18: mol_type = other DNA
taattcgtttcaatttag

SEQ ID NO: 69505 - DNA, 18 bp, synthetic construct
  source 1..18: mol_type = other DNA
taattctcttcttcgtag

SEQ ID NO: 69506 - DNA, 18 bp, synthetic construct
  source 1..18: mol_type = other DNA
taattctgcttacaatag

SEQ ID NO: 69507 - DNA, 18 bp, synthetic construct
  source 1..18: mol_type = other DNA
taattcttctcacaattg

SEQ ID NO: 69508 - DNA, 18 bp, synthetic construct
  source 1..18: mol_type = other DNA
taattcttctctctttag

SEQ ID NO: 69509 - DNA, 18 bp, synthetic construct
  source 1..18: mol_type = other DNA
taattggtcacacgatag

SEQ ID NO: 69510 - DNA, 18 bp, synthetic construct
  source 1..18: mol_type = other DNA
taatttgacattctctag

SEQ ID NO: 69511 - DNA, 18 bp, synthetic construct
  source 1..18: mol_type = other DNA
taatttgcctcacttcag

SEQ ID NO: 69512 - DNA, 18 bp, synthetic construct
  source 1..18: mol_type = other DNA
taatttggctcacttgag

SEQ ID NO: 69513 - DNA, 18 bp, synthetic construct
  source 1..18: mol_type = other DNA
taatttgtatcaccatag

SEQ ID NO: 69514 - DNA, 18 bp, synthetic construct
  source 1..18: mol_type = other DNA
taatttttttcactaaag

SEQ ID NO: 69515 - DNA, 18 bp, synthetic construct
  source 1..18: mol_type = other DNA
tacaaagactccctattg

SEQ ID NO: 69516 - DNA, 18 bp, synthetic construct
  source 1..18: mol_type = other DNA
tacaaagacttagtatag

SEQ ID NO: 69517 - DNA, 18 bp, synthetic construct
  source 1..18: mol_type = other DNA
tacaacgacacacttttg

SEQ ID NO: 69518 - DNA, 18 bp, synthetic construct
  source 1..18: mol_type = other DNA
tacaacgtctatctatag

SEQ ID NO: 69519 - DNA, 18 bp, synthetic construct
  source 1..18: mol_type = other DNA
tacaaggactctctttag

SEQ ID NO: 69520 - DNA, 18 bp, synthetic construct
  source 1..18: mol_type = other DNA
tacaccgacagtctagag

SEQ ID NO: 69521 - DNA, 18 bp, synthetic construct
  source 1..18: mol_type = other DNA
taccacgagttactctcg

SEQ ID NO: 69522 - DNA, 18 bp, synthetic construct
  source 1..18: mol_type = other DNA
tacctcaactcactttag

SEQ ID NO: 69523 - DNA, 18 bp, synthetic construct
  source 1..18: mol_type = other DNA
tacgacgactaaacatag

SEQ ID NO: 69524 - DNA, 18 bp, synthetic construct
  source 1..18: mol_type = other DNA
tacgatgacaaagtgtag

SEQ ID NO: 69525 - DNA, 18 bp, synthetic construct
  source 1..18: mol_type = other DNA
tactaagaataacattag

SEQ ID NO: 69526 - DNA, 18 bp, synthetic construct
  source 1..18: mol_type = other DNA
tactaagactcagtaatg

SEQ ID NO: 69527 - DNA, 18 bp, synthetic construct
  source 1..18: mol_type = other DNA
tactacgagtcatttcag

SEQ ID NO: 69528 - DNA, 18 bp, synthetic construct
  source 1..18: mol_type = other DNA
tactacgcatacctgtag

SEQ ID NO: 69529 - DNA, 18 bp, synthetic construct
  source 1..18: mol_type = other DNA
tactatgactttttaaag

SEQ ID NO: 69530 - DNA, 18 bp, synthetic construct
  source 1..18: mol_type = other DNA
tactcagacttactattg

SEQ ID NO: 69531 - DNA, 18 bp, synthetic construct
  source 1..18: mol_type = other DNA
tactcccactcattttag

SEQ ID NO: 69532 - DNA, 18 bp, synthetic construct
  source 1..18: mol_type = other DNA
tactccgcctcacttttg

SEQ ID NO: 69533 - DNA, 18 bp, synthetic construct
  source 1..18: mol_type = other DNA
tactcctactgattattg

SEQ ID NO: 69534 - DNA, 18 bp, synthetic construct
  source 1..18: mol_type = other DNA
tactgcgacacattattg

SEQ ID NO: 69535 - DNA, 18 bp, synthetic construct
  source 1..18: mol_type = other DNA
tacttagactcaataatg

SEQ ID NO: 69536 - DNA, 18 bp, synthetic construct
  source 1..18: mol_type = other DNA
tacttagactctcaattg

SEQ ID NO: 69537 - DNA, 18 bp, synthetic construct
  source 1..18: mol_type = other DNA
tacttcaactgaccatag

SEQ ID NO: 69538 - DNA, 18 bp, synthetic construct
  source 1..18: mol_type = other DNA
tactttgacgctgcttag

SEQ ID NO: 69539 - DNA, 18 bp, synthetic construct
  source 1..18: mol_type = other DNA
tagaacaattcaatatcg

SEQ ID NO: 69540 - DNA, 18 bp, synthetic construct
  source 1..18: mol_type = other DNA
tagaacatctctctatag

SEQ ID NO: 69541 - DNA, 18 bp, synthetic construct
  source 1..18: mol_type = other DNA
tagaacgacacagtattg

SEQ ID NO: 69542 - DNA, 18 bp, synthetic construct
  source 1..18: mol_type = other DNA
tagaacgagccattatgg

SEQ ID NO: 69543 - DNA, 18 bp, synthetic construct
  source 1..18: mol_type = other DNA
tagaacgatccactaaag

SEQ ID NO: 69544 - DNA, 18 bp, synthetic construct
  source 1..18: mol_type = other DNA
tagaacgcctaactaaag

SEQ ID NO: 69545 - DNA, 18 bp, synthetic construct
  source 1..18: mol_type = other DNA
tagcaagactcattattg

SEQ ID NO: 69546 - DNA, 18 bp, synthetic construct
  source 1..18: mol_type = other DNA
tagcaggtatcttgttgg

SEQ ID NO: 69547 - DNA, 18 bp, synthetic construct
  source 1..18: mol_type = other DNA
tagcatgactcataaaag

SEQ ID NO: 69548 - DNA, 18 bp, synthetic construct
  source 1..18: mol_type = other DNA
tagcgcgtctcacaattg

SEQ ID NO: 69549 - DNA, 18 bp, synthetic construct
  source 1..18: mol_type = other DNA
tagctcagctcacttttg

SEQ ID NO: 69550 - DNA, 18 bp, synthetic construct
  source 1..18: mol_type = other DNA
taggatgtctgactatag

SEQ ID NO: 69551 - DNA, 18 bp, synthetic construct
  source 1..18: mol_type = other DNA
tagtaagaatacctatag

SEQ ID NO: 69552 - DNA, 18 bp, synthetic construct
  source 1..18: mol_type = other DNA
tagtacaacttccaatag

SEQ ID NO: 69553 - DNA, 18 bp, synthetic construct
  source 1..18: mol_type = other DNA
tagtacatatctctatag

SEQ ID NO: 69554 - DNA, 18 bp, synthetic construct
  source 1..18: mol_type = other DNA
tagtacgattctcattag

SEQ ID NO: 69555 - DNA, 18 bp, synthetic construct
  source 1..18: mol_type = other DNA
tagtactacgctcaatcg

SEQ ID NO: 69556 - DNA, 18 bp, synthetic construct
  source 1..18: mol_type = other DNA
tagtataacacaatgtag

SEQ ID NO: 69557 - DNA, 18 bp, synthetic construct
  source 1..18: mol_type = other DNA
tagtataagccactatag

SEQ ID NO: 69558 - DNA, 18 bp, synthetic construct
  source 1..18: mol_type = other DNA
tagtatctttgattatag

SEQ ID NO: 69559 - DNA, 18 bp, synthetic construct
  source 1..18: mol_type = other DNA
tagtatgacacactaagg

SEQ ID NO: 69560 - DNA, 18 bp, synthetic construct
  source 1..18: mol_type = other DNA
tagtatgacgcagtactg

SEQ ID NO: 69561 - DNA, 18 bp, synthetic construct
  source 1..18: mol_type = other DNA
tagttaaacactctatag

SEQ ID NO: 69562 - DNA, 18 bp, synthetic construct
  source 1..18: mol_type = other DNA
tagttcaccccacattag

SEQ ID NO: 69563 - DNA, 18 bp, synthetic construct
  source 1..18: mol_type = other DNA
tagttccgctcactacag

SEQ ID NO: 69564 - DNA, 18 bp, synthetic construct
  source 1..18: mol_type = other DNA
tagttcgactcaaaaaag

SEQ ID NO: 69565 - DNA, 18 bp, synthetic construct
  source 1..18: mol_type = other DNA
tataaagattcaatattg

SEQ ID NO: 69566 - DNA, 18 bp, synthetic construct
  source 1..18: mol_type = other DNA
tataacaaatcactattg

SEQ ID NO: 69567 - DNA, 18 bp, synthetic construct
  source 1..18: mol_type = other DNA
tataacaacacactaaag

SEQ ID NO: 69568 - DNA, 18 bp, synthetic construct
  source 1..18: mol_type = other DNA
tataacctatcgctaaag

SEQ ID NO: 69569 - DNA, 18 bp, synthetic construct
  source 1..18: mol_type = other DNA
tataacgactaaattcag

SEQ ID NO: 69570 - DNA, 18 bp, synthetic construct
  source 1..18: mol_type = other DNA
tataacgacttactcttg

SEQ ID NO: 69571 - DNA, 18 bp, synthetic construct
  source 1..18: mol_type = other DNA
tataacgccccacaatag

SEQ ID NO: 69572 - DNA, 18 bp, synthetic construct
  source 1..18: mol_type = other DNA
tataacgcctcactttcg

SEQ ID NO: 69573 - DNA, 18 bp, synthetic construct
  source 1..18: mol_type = other DNA
tataacggctctctattg

SEQ ID NO: 69574 - DNA, 18 bp, synthetic construct
  source 1..18: mol_type = other DNA
tataacggctctcttttg

SEQ ID NO: 69575 - DNA, 18 bp, synthetic construct
  source 1..18: mol_type = other DNA
tataacgtctcataatag

SEQ ID NO: 69576 - DNA, 18 bp, synthetic construct
  source 1..18: mol_type = other DNA
tataacgtcttgctctag

SEQ ID NO: 69577 - DNA, 18 bp, synthetic construct
  source 1..18: mol_type = other DNA
tataacgttttactatag

SEQ ID NO: 69578 - DNA, 18 bp, synthetic construct
  source 1..18: mol_type = other DNA
tataactagtcactatcg

SEQ ID NO: 69579 - DNA, 18 bp, synthetic construct
  source 1..18: mol_type = other DNA
tataagctctcacagtag

SEQ ID NO: 69580 - DNA, 18 bp, synthetic construct
  source 1..18: mol_type = other DNA
tataataactcacaggtg

SEQ ID NO: 69581 - DNA, 18 bp, synthetic construct
  source 1..18: mol_type = other DNA
tataatgagtctctatag

SEQ ID NO: 69582 - DNA, 18 bp, synthetic construct
  source 1..18: mol_type = other DNA
tataatgtcacacaatag

SEQ ID NO: 69583 - DNA, 18 bp, synthetic construct
  source 1..18: mol_type = other DNA
tataattactcactaaag

SEQ ID NO: 69584 - DNA, 18 bp, synthetic construct
  source 1..18: mol_type = other DNA
tatagcaactctctaaag

SEQ ID NO: 69585 - DNA, 18 bp, synthetic construct
  source 1..18: mol_type = other DNA
tatatcgactctcgatag

SEQ ID NO: 69586 - DNA, 18 bp, synthetic construct
  source 1..18: mol_type = other DNA
tatcaagagtttctgtag

SEQ ID NO: 69587 - DNA, 18 bp, synthetic construct
  source 1..18: mol_type = other DNA
tatcacgacagtctatag

SEQ ID NO: 69588 - DNA, 18 bp, synthetic construct
  source 1..18: mol_type = other DNA
tatcacgacttactttcg

SEQ ID NO: 69589 - DNA, 18 bp, synthetic construct
  source 1..18: mol_type = other DNA
tatcacgctttactattg

SEQ ID NO: 69590 - DNA, 18 bp, synthetic construct
  source 1..18: mol_type = other DNA
tatcatgacacactaatg

SEQ ID NO: 69591 - DNA, 18 bp, synthetic construct
  source 1..18: mol_type = other DNA
tatcatgactcattaaag

SEQ ID NO: 69592 - DNA, 18 bp, synthetic construct
  source 1..18: mol_type = other DNA
tatcatgactctctattg

SEQ ID NO: 69593 - DNA, 18 bp, synthetic construct
  source 1..18: mol_type = other DNA
tatctcaaattactgtag

SEQ ID NO: 69594 - DNA, 18 bp, synthetic construct
  source 1..18: mol_type = other DNA
tatctcaactcattatag

SEQ ID NO: 69595 - DNA, 18 bp, synthetic construct
  source 1..18: mol_type = other DNA
tatctcgactaactattg

SEQ ID NO: 69596 - DNA, 18 bp, synthetic construct
  source 1..18: mol_type = other DNA
tatgttgacttactgaag

SEQ ID NO: 69597 - DNA, 18 bp, synthetic construct
  source 1..18: mol_type = other DNA
tattaaaactctcaatag

SEQ ID NO: 69598 - DNA, 18 bp, synthetic construct
  source 1..18: mol_type = other DNA
tattaaaactctctctag

SEQ ID NO: 69599 - DNA, 18 bp, synthetic construct
  source 1..18: mol_type = other DNA
tattaagacacactacgg

SEQ ID NO: 69600 - DNA, 18 bp, synthetic construct
  source 1..18: mol_type = other DNA
tattaagactaaatttag

SEQ ID NO: 69601 - DNA, 18 bp, synthetic construct
  source 1..18: mol_type = other DNA
tattaagcaattttatag

SEQ ID NO: 69602 - DNA, 18 bp, synthetic construct
  source 1..18: mol_type = other DNA
tattaaggtacactttag

SEQ ID NO: 69603 - DNA, 18 bp, synthetic construct
  source 1..18: mol_type = other DNA
tattaagtctcacaattg

SEQ ID NO: 69604 - DNA, 18 bp, synthetic construct
  source 1..18: mol_type = other DNA
tattacaacactctgtag

SEQ ID NO: 69605 - DNA, 18 bp, synthetic construct
  source 1..18: mol_type = other DNA
tattacaacacttgatag

SEQ ID NO: 69606 - DNA, 18 bp, synthetic construct
  source 1..18: mol_type = other DNA
tattacaacccataatag

SEQ ID NO: 69607 - DNA, 18 bp, synthetic construct
  source 1..18: mol_type = other DNA
tattacaagtcacttttg

SEQ ID NO: 69608 - DNA, 18 bp, synthetic construct
  source 1..18: mol_type = other DNA
tattacacgtctcttttg

SEQ ID NO: 69609 - DNA, 18 bp, synthetic construct
  source 1..18: mol_type = other DNA
tattaccaggctcagtag

SEQ ID NO: 69610 - DNA, 18 bp, synthetic construct
  source 1..18: mol_type = other DNA
tattacgaaccataacag

SEQ ID NO: 69611 - DNA, 18 bp, synthetic construct
  source 1..18: mol_type = other DNA
tattacgacactccaacg

SEQ ID NO: 69612 - DNA, 18 bp, synthetic construct
  source 1..18: mol_type = other DNA
tattacgactatatattg

SEQ ID NO: 69613 - DNA, 18 bp, synthetic construct
  source 1..18: mol_type = other DNA
tattacgactcaaataag

SEQ ID NO: 69614 - DNA, 18 bp, synthetic construct
  source 1..18: mol_type = other DNA
tattacgactccattttg

SEQ ID NO: 69615 - DNA, 18 bp, synthetic construct
  source 1..18: mol_type = other DNA
tattacgactctcggtcg

SEQ ID NO: 69616 - DNA, 18 bp, synthetic construct
  source 1..18: mol_type = other DNA
tattacgactttctaatg

SEQ ID NO: 69617 - DNA, 18 bp, synthetic construct
  source 1..18: mol_type = other DNA
tattacgagactcaatgg

SEQ ID NO: 69618 - DNA, 18 bp, synthetic construct
  source 1..18: mol_type = other DNA
tattacgagtctttaaag

SEQ ID NO: 69619 - DNA, 18 bp, synthetic construct
  source 1..18: mol_type = other DNA
tattacgatgatctctag

SEQ ID NO: 69620 - DNA, 18 bp, synthetic construct
  source 1..18: mol_type = other DNA
tattacgtatcacttaag

SEQ ID NO: 69621 - DNA, 18 bp, synthetic construct
  source 1..18: mol_type = other DNA
tattacgtctctttagag

SEQ ID NO: 69622 - DNA, 18 bp, synthetic construct
  source 1..18: mol_type = other DNA
tattacgtgacacaatag

SEQ ID NO: 69623 - DNA, 18 bp, synthetic construct
  source 1..18: mol_type = other DNA
tattacgtgtcgctatcg

SEQ ID NO: 69624 - DNA, 18 bp, synthetic construct
  source 1..18: mol_type = other DNA
tattacgttttactaaag

SEQ ID NO: 69625 - DNA, 18 bp, synthetic construct
  source 1..18: mol_type = other DNA
tattactaatcacataag

SEQ ID NO: 69626 - DNA, 18 bp, synthetic construct
  source 1..18: mol_type = other DNA
tattactaatttctttag

SEQ ID NO: 69627 - DNA, 18 bp, synthetic construct
  source 1..18: mol_type = other DNA
tattactactctcaattg

SEQ ID NO: 69628 - DNA, 18 bp, synthetic construct
  source 1..18: mol_type = other DNA
tattactatccattctag

SEQ ID NO: 69629 - DNA, 18 bp, synthetic construct
  source 1..18: mol_type = other DNA
tattactccacactaaag

SEQ ID NO: 69630 - DNA, 18 bp, synthetic construct
  source 1..18: mol_type = other DNA
tattactcctcattattg

SEQ ID NO: 69631 - DNA, 18 bp, synthetic construct
  source 1..18: mol_type = other DNA
tattacttctcacttttg

SEQ ID NO: 69632 - DNA, 18 bp, synthetic construct
  source 1..18: mol_type = other DNA
tattacttctcgctttag

SEQ ID NO: 69633 - DNA, 18 bp, synthetic construct
  source 1..18: mol_type = other DNA
tattaggacctactacag

SEQ ID NO: 69634 - DNA, 18 bp, synthetic construct
  source 1..18: mol_type = other DNA
tattaggagtcaacttag

SEQ ID NO: 69635 - DNA, 18 bp, synthetic construct
  source 1..18: mol_type = other DNA
tattaggcctcacaaaag

SEQ ID NO: 69636 - DNA, 18 bp, synthetic construct
  source 1..18: mol_type = other DNA
tattataactcagaatag

SEQ ID NO: 69637 - DNA, 18 bp, synthetic construct
  source 1..18: mol_type = other DNA
tattatcacactcgatag

SEQ ID NO: 69638 - DNA, 18 bp, synthetic construct
  source 1..18: mol_type = other DNA
tattatctttcattatcg

SEQ ID NO: 69639 - DNA, 18 bp, synthetic construct
  source 1..18: mol_type = other DNA
tattatgactcattaatg

SEQ ID NO: 69640 - DNA, 18 bp, synthetic construct
  source 1..18: mol_type = other DNA
tattatgtctcaccacag

SEQ ID NO: 69641 - DNA, 18 bp, synthetic construct
  source 1..18: mol_type = other DNA
tattatgtctcacttttg

SEQ ID NO: 69642 - DNA, 18 bp, synthetic construct
  source 1..18: mol_type = other DNA
tattattacacacaattg

SEQ ID NO: 69643 - DNA, 18 bp, synthetic construct
  source 1..18: mol_type = other DNA
tattccctacctcaattg

SEQ ID NO: 69644 - DNA, 18 bp, synthetic construct
  source 1..18: mol_type = other DNA
tattccgcctttcaaaag

SEQ ID NO: 69645 - DNA, 18 bp, synthetic construct
  source 1..18: mol_type = other DNA
tattcctagacattatag

SEQ ID NO: 69646 - DNA, 18 bp, synthetic construct
  source 1..18: mol_type = other DNA
tatttcaactttctatag

SEQ ID NO: 69647 - DNA, 18 bp, synthetic construct
  source 1..18: mol_type = other DNA
tatttccactgactattg

SEQ ID NO: 69648 - DNA, 18 bp, synthetic construct
  source 1..18: mol_type = other DNA
tatttcgaatctctttag

SEQ ID NO: 69649 - DNA, 18 bp, synthetic construct
  source 1..18: mol_type = other DNA
tatttcgactcacttctg

SEQ ID NO: 69650 - DNA, 18 bp, synthetic construct
  source 1..18: mol_type = other DNA
tatttcgacttaatatgg

SEQ ID NO: 69651 - DNA, 18 bp, synthetic construct
  source 1..18: mol_type = other DNA
tatttcgatttacaatag

SEQ ID NO: 69652 - DNA, 18 bp, synthetic construct
  source 1..18: mol_type = other DNA
tatttcgcctctcaatag

SEQ ID NO: 69653 - DNA, 18 bp, synthetic construct
  source 1..18: mol_type = other DNA
tatttcgtatcacaattg

SEQ ID NO: 69654 - DNA, 18 bp, synthetic construct
  source 1..18: mol_type = other DNA
tatttcgtctcactaatg

SEQ ID NO: 69655 - DNA, 18 bp, synthetic construct
  source 1..18: mol_type = other DNA
tatttctacttacaatag

SEQ ID NO: 69656 - DNA, 18 bp, synthetic construct
  source 1..18: mol_type = other DNA
tatttctacttacattag

SEQ ID NO: 69657 - DNA, 18 bp, synthetic construct
  source 1..18: mol_type = other DNA
tatttctcctcacttgag

SEQ ID NO: 69658 - DNA, 18 bp, synthetic construct
  source 1..18: mol_type = other DNA
tcaaacgactcatgttcg

SEQ ID NO: 69659 - DNA, 18 bp, synthetic construct
  source 1..18: mol_type = other DNA
tcaaacgttttacagtag

SEQ ID NO: 69660 - DNA, 18 bp, synthetic construct
  source 1..18: mol_type = other DNA
tcaatcgactcatcttag

SEQ ID NO: 69661 - DNA, 18 bp, synthetic construct
  source 1..18: mol_type = other DNA
tcacacggcttactaaag

SEQ ID NO: 69662 - DNA, 18 bp, synthetic construct
  source 1..18: mol_type = other DNA
tcacaggcttagctacag

SEQ ID NO: 69663 - DNA, 18 bp, synthetic construct
  source 1..18: mol_type = other DNA
tcactcgccgcactatag

SEQ ID NO: 69664 - DNA, 18 bp, synthetic construct
  source 1..18: mol_type = other DNA
tcataatatttactatag

SEQ ID NO: 69665 - DNA, 18 bp, synthetic construct
  source 1..18: mol_type = other DNA
tcatacctctcgctttgg

SEQ ID NO: 69666 - DNA, 18 bp, synthetic construct
  source 1..18: mol_type = other DNA
tcatacgacagacttttg

SEQ ID NO: 69667 - DNA, 18 bp, synthetic construct
  source 1..18: mol_type = other DNA
tcatacgacttatttatg

SEQ ID NO: 69668 - DNA, 18 bp, synthetic construct
  source 1..18: mol_type = other DNA
tcatacgatccaataaag

SEQ ID NO: 69669 - DNA, 18 bp, synthetic construct
  source 1..18: mol_type = other DNA
tcatactactcacagttg

SEQ ID NO: 69670 - DNA, 18 bp, synthetic construct
  source 1..18: mol_type = other DNA
tcatactactcgcttaag

SEQ ID NO: 69671 - DNA, 18 bp, synthetic construct
  source 1..18: mol_type = other DNA
tcatactatatgctaaag

SEQ ID NO: 69672 - DNA, 18 bp, synthetic construct
  source 1..18: mol_type = other DNA
tcatataactaacaattg

SEQ ID NO: 69673 - DNA, 18 bp, synthetic construct
  source 1..18: mol_type = other DNA
tcatatcgctcacaaaag

SEQ ID NO: 69674 - DNA, 18 bp, synthetic construct
  source 1..18: mol_type = other DNA
tcatatgaatctccatag

SEQ ID NO: 69675 - DNA, 18 bp, synthetic construct
  source 1..18: mol_type = other DNA
tcatccatctcactacag

SEQ ID NO: 69676 - DNA, 18 bp, synthetic construct
  source 1..18: mol_type = other DNA
tcatccgagatactctag

SEQ ID NO: 69677 - DNA, 18 bp, synthetic construct
  source 1..18: mol_type = other DNA
tcatctgtctcaccatag

SEQ ID NO: 69678 - DNA, 18 bp, synthetic construct
  source 1..18: mol_type = other DNA
tcatgaggctcacattag

SEQ ID NO: 69679 - DNA, 18 bp, synthetic construct
  source 1..18: mol_type = other DNA
tcatgggactctctacag

SEQ ID NO: 69680 - DNA, 18 bp, synthetic construct
  source 1..18: mol_type = other DNA
tcattagtctcgcagatg

SEQ ID NO: 69681 - DNA, 18 bp, synthetic construct
  source 1..18: mol_type = other DNA
tcattcgactttctacag

SEQ ID NO: 69682 - DNA, 18 bp, synthetic construct
  source 1..18: mol_type = other DNA
tcattcgtcctgttatag

SEQ ID NO: 69683 - DNA, 18 bp, synthetic construct
  source 1..18: mol_type = other DNA
tcatttgacacgcgatag

SEQ ID NO: 69684 - DNA, 18 bp, synthetic construct
  source 1..18: mol_type = other DNA
tccaacgaccctttatag

SEQ ID NO: 69685 - DNA, 18 bp, synthetic construct
  source 1..18: mol_type = other DNA
tccaacgtctctctatag

SEQ ID NO: 69686 - DNA, 18 bp, synthetic construct
  source 1..18: mol_type = other DNA
tcctacgagtgtcatccg

SEQ ID NO: 69687 - DNA, 18 bp, synthetic construct
  source 1..18: mol_type = other DNA
tcgaacgacacactaacg

SEQ ID NO: 69688 - DNA, 18 bp, synthetic construct
  source 1..18: mol_type = other DNA
tctaacaactcactattg

SEQ ID NO: 69689 - DNA, 18 bp, synthetic construct
  source 1..18: mol_type = other DNA
tctaacaactcactttag

SEQ ID NO: 69690 - DNA, 18 bp, synthetic construct
  source 1..18: mol_type = other DNA
tctaacgactctctaacg

SEQ ID NO: 69691 - DNA, 18 bp, synthetic construct
  source 1..18: mol_type = other DNA
tctcaagtctcacttttg

SEQ ID NO: 69692 - DNA, 18 bp, synthetic construct
  source 1..18: mol_type = other DNA
tctgactacagacaattg

SEQ ID NO: 69693 - DNA, 18 bp, synthetic construct
  source 1..18: mol_type = other DNA
tcttacaacactctatag

SEQ ID NO: 69694 - DNA, 18 bp, synthetic construct
  source 1..18: mol_type = other DNA
tcttaccattcactcccg

SEQ ID NO: 69695 - DNA, 18 bp, synthetic construct
  source 1..18: mol_type = other DNA
tcttacttcatactatag

SEQ ID NO: 69696 - DNA, 18 bp, synthetic construct
  source 1..18: mol_type = other DNA
tctttctactctctctag

SEQ ID NO: 69697 - DNA, 18 bp, synthetic construct
  source 1..18: mol_type = other DNA
tgaaacgacacaataacg

SEQ ID NO: 69698 - DNA, 18 bp, synthetic construct
  source 1..18: mol_type = other DNA
tgaaacgagtcaccatcg

SEQ ID NO: 69699 - DNA, 18 bp, synthetic construct
  source 1..18: mol_type = other DNA
tgaaccgacacacgagag

SEQ ID NO: 69700 - DNA, 18 bp, synthetic construct
  source 1..18: mol_type = other DNA
tgaaccttctttctatag

SEQ ID NO: 69701 - DNA, 18 bp, synthetic construct
  source 1..18: mol_type = other DNA
tgaatggactcaccaaag

SEQ ID NO: 69702 - DNA, 18 bp, synthetic construct
  source 1..18: mol_type = other DNA
tgacacttcacactatag

SEQ ID NO: 69703 - DNA, 18 bp, synthetic construct
  source 1..18: mol_type = other DNA
tgatacaaatcaaaatag

SEQ ID NO: 69704 - DNA, 18 bp, synthetic construct
  source 1..18: mol_type = other DNA
tgatacaacttatcatag

SEQ ID NO: 69705 - DNA, 18 bp, synthetic construct
  source 1..18: mol_type = other DNA
tgatacgaatcatttttg

SEQ ID NO: 69706 - DNA, 18 bp, synthetic construct
  source 1..18: mol_type = other DNA
tgatacgacttgcaattg

SEQ ID NO: 69707 - DNA, 18 bp, synthetic construct
  source 1..18: mol_type = other DNA
tgatacgactttcaaagg

SEQ ID NO: 69708 - DNA, 18 bp, synthetic construct
  source 1..18: mol_type = other DNA
tgatacgagtgacgttgg

SEQ ID NO: 69709 - DNA, 18 bp, synthetic construct
  source 1..18: mol_type = other DNA
tgatacgagtgactaatg

SEQ ID NO: 69710 - DNA, 18 bp, synthetic construct
  source 1..18: mol_type = other DNA
tgatacgattcattcaag

SEQ ID NO: 69711 - DNA, 18 bp, synthetic construct
  source 1..18: mol_type = other DNA
tgatactaatccctttag

SEQ ID NO: 69712 - DNA, 18 bp, synthetic construct
  source 1..18: mol_type = other DNA
tgatactacacacctgag

SEQ ID NO: 69713 - DNA, 18 bp, synthetic construct
  source 1..18: mol_type = other DNA
tgatactacacgctaaag

SEQ ID NO: 69714 - DNA, 18 bp, synthetic construct
  source 1..18: mol_type = other DNA
tgataggactgtctatgg

SEQ ID NO: 69715 - DNA, 18 bp, synthetic construct
  source 1..18: mol_type = other DNA
tgatatgtcactctatag

SEQ ID NO: 69716 - DNA, 18 bp, synthetic construct
  source 1..18: mol_type = other DNA
tgatccgtatctctatag

SEQ ID NO: 69717 - DNA, 18 bp, synthetic construct
  source 1..18: mol_type = other DNA
tgatgcgactaactactg

SEQ ID NO: 69718 - DNA, 18 bp, synthetic construct
  source 1..18: mol_type = other DNA
tgatgcgccccaataaag

SEQ ID NO: 69719 - DNA, 18 bp, synthetic construct
  source 1..18: mol_type = other DNA
tgattcaactccttctag

SEQ ID NO: 69720 - DNA, 18 bp, synthetic construct
  source 1..18: mol_type = other DNA
tgattcgaatttcgatgg

SEQ ID NO: 69721 - DNA, 18 bp, synthetic construct
  source 1..18: mol_type = other DNA
tgattcgtttccctatag

SEQ ID NO: 69722 - DNA, 18 bp, synthetic construct
  source 1..18: mol_type = other DNA
tgcaacgactcacctttg

SEQ ID NO: 69723 - DNA, 18 bp, synthetic construct
  source 1..18: mol_type = other DNA
tgctactacacccaattg

SEQ ID NO: 69724 - DNA, 18 bp, synthetic construct
  source 1..18: mol_type = other DNA
tggaaccaatcgctttag

SEQ ID NO: 69725 - DNA, 18 bp, synthetic construct
  source 1..18: mol_type = other DNA
tggtacaccactctatag

SEQ ID NO: 69726 - DNA, 18 bp, synthetic construct
  source 1..18: mol_type = other DNA
tgttacgagtcactaatg

SEQ ID NO: 69727 - DNA, 18 bp, synthetic construct
  source 1..18: mol_type = other DNA
tgttacgtcttactaaag

SEQ ID NO: 69728 - DNA, 18 bp, synthetic construct
  source 1..18: mol_type = other DNA
tgttactacaccttatgg

SEQ ID NO: 69729 - DNA, 18 bp, synthetic construct
  source 1..18: mol_type = other DNA
tgttactattgacaatag

SEQ ID NO: 69730 - DNA, 18 bp, synthetic construct
  source 1..18: mol_type = other DNA
tgttaggatttactattg

SEQ ID NO: 69731 - DNA, 18 bp, synthetic construct
  source 1..18: mol_type = other DNA
tgttatgcgttactttag

SEQ ID NO: 69732 - DNA, 18 bp, synthetic construct
  source 1..18: mol_type = other DNA
tgttgggaatcactatag

SEQ ID NO: 69733 - DNA, 18 bp, synthetic construct
  source 1..18: mol_type = other DNA
ttaaaaaactcactatcg

SEQ ID NO: 69734 - DNA, 18 bp, synthetic construct
  source 1..18: mol_type = other DNA
ttaaaagacgaattgtag

SEQ ID NO: 69735 - DNA, 18 bp, synthetic construct
  source 1..18: mol_type = other DNA
ttaaaatacttcctatag

SEQ ID NO: 69736 - DNA, 18 bp, synthetic construct
  source 1..18: mol_type = other DNA
ttaaacaattcacactag

SEQ ID NO: 69737 - DNA, 18 bp, synthetic construct
  source 1..18: mol_type = other DNA
ttaaacgaaccactaaag

SEQ ID NO: 69738 - DNA, 18 bp, synthetic construct
  source 1..18: mol_type = other DNA
ttaaacgattctatgtag

SEQ ID NO: 69739 - DNA, 18 bp, synthetic construct
  source 1..18: mol_type = other DNA
ttaaaggacctactatag

SEQ ID NO: 69740 - DNA, 18 bp, synthetic construct
  source 1..18: mol_type = other DNA
ttaaaggcctaactattg

SEQ ID NO: 69741 - DNA, 18 bp, synthetic construct
  source 1..18: mol_type = other DNA
ttaagccactcactaggg

SEQ ID NO: 69742 - DNA, 18 bp, synthetic construct
  source 1..18: mol_type = other DNA
ttaatcatctcactatag

SEQ ID NO: 69743 - DNA, 18 bp, synthetic construct
  source 1..18: mol_type = other DNA
ttaatccagtctctatag

SEQ ID NO: 69744 - DNA, 18 bp, synthetic construct
  source 1..18: mol_type = other DNA
ttaatctactcactaatg

SEQ ID NO: 69745 - DNA, 18 bp, synthetic construct
  source 1..18: mol_type = other DNA
ttaatggaatttctatag

SEQ ID NO: 69746 - DNA, 18 bp, synthetic construct
  source 1..18: mol_type = other DNA
ttacaccccgaactatag

SEQ ID NO: 69747 - DNA, 18 bp, synthetic construct
  source 1..18: mol_type = other DNA
ttacacgacacaccattg

SEQ ID NO: 69748 - DNA, 18 bp, synthetic construct
  source 1..18: mol_type = other DNA
ttacatcactcactatgg

SEQ ID NO: 69749 - DNA, 18 bp, synthetic construct
  source 1..18: mol_type = other DNA
ttacatgtctcactttag

SEQ ID NO: 69750 - DNA, 18 bp, synthetic construct
  source 1..18: mol_type = other DNA
ttacatgtctcactttgg

SEQ ID NO: 69751 - DNA, 18 bp, synthetic construct
  source 1..18: mol_type = other DNA
ttacattactcaatacag

SEQ ID NO: 69752 - DNA, 18 bp, synthetic construct
  source 1..18: mol_type = other DNA
ttagacaatccactagag

SEQ ID NO: 69753 - DNA, 18 bp, synthetic construct
  source 1..18: mol_type = other DNA
ttagactactccctaacg

SEQ ID NO: 69754 - DNA, 18 bp, synthetic construct
  source 1..18: mol_type = other DNA
ttataaaacacactgtag

SEQ ID NO: 69755 - DNA, 18 bp, synthetic construct
  source 1..18: mol_type = other DNA
ttataaaattcgcactag

SEQ ID NO: 69756 - DNA, 18 bp, synthetic construct
  source 1..18: mol_type = other DNA
ttataacactaactatcg

SEQ ID NO: 69757 - DNA, 18 bp, synthetic construct
  source 1..18: mol_type = other DNA
ttataagtcccactattg

SEQ ID NO: 69758 - DNA, 18 bp, synthetic construct
  source 1..18: mol_type = other DNA
ttataatactaactctag

SEQ ID NO: 69759 - DNA, 18 bp, synthetic construct
  source 1..18: mol_type = other DNA
ttatacaacttacattag

SEQ ID NO: 69760 - DNA, 18 bp, synthetic construct
  source 1..18: mol_type = other DNA
ttatacaattcagtttag

SEQ ID NO: 69761 - DNA, 18 bp, synthetic construct
  source 1..18: mol_type = other DNA
ttataccactcagaagag

SEQ ID NO: 69762 - DNA, 18 bp, synthetic construct
  source 1..18: mol_type = other DNA
ttatacgaatcaagatcg

SEQ ID NO: 69763 - DNA, 18 bp, synthetic construct
  source 1..18: mol_type = other DNA
ttatacgaatctataatg

SEQ ID NO: 69764 - DNA, 18 bp, synthetic construct
  source 1..18: mol_type = other DNA
ttatacgaatgaatactg

SEQ ID NO: 69765 - DNA, 18 bp, synthetic construct
  source 1..18: mol_type = other DNA
ttatacgacaatctactg

SEQ ID NO: 69766 - DNA, 18 bp, synthetic construct
  source 1..18: mol_type = other DNA
ttatacgacacacacaag

SEQ ID NO: 69767 - DNA, 18 bp, synthetic construct
  source 1..18: mol_type = other DNA
ttatacgacacgctgttg

SEQ ID NO: 69768 - DNA, 18 bp, synthetic construct
  source 1..18: mol_type = other DNA
ttatacgacataataaag

SEQ ID NO: 69769 - DNA, 18 bp, synthetic construct
  source 1..18: mol_type = other DNA
ttatacgacatactatca

SEQ ID NO: 69770 - DNA, 18 bp, synthetic construct
  source 1..18: mol_type = other DNA
ttatacgactcttcaaag

SEQ ID NO: 69771 - DNA, 18 bp, synthetic construct
  source 1..18: mol_type = other DNA
ttatacgactggctcaag

SEQ ID NO: 69772 - DNA, 18 bp, synthetic construct
  source 1..18: mol_type = other DNA
ttatacgacttatttttg

SEQ ID NO: 69773 - DNA, 18 bp, synthetic construct
  source 1..18: mol_type = other DNA
ttatacgagtctcttaag

SEQ ID NO: 69774 - DNA, 18 bp, synthetic construct
  source 1..18: mol_type = other DNA
ttatacgatacaatactg

SEQ ID NO: 69775 - DNA, 18 bp, synthetic construct
  source 1..18: mol_type = other DNA
ttatacgattcacaaatg

SEQ ID NO: 69776 - DNA, 18 bp, synthetic construct
  source 1..18: mol_type = other DNA
ttatacgattctctaatg

SEQ ID NO: 69777 - DNA, 18 bp, synthetic construct
  source 1..18: mol_type = other DNA
ttatacgccttattttag

SEQ ID NO: 69778 - DNA, 18 bp, synthetic construct
  source 1..18: mol_type = other DNA
ttatacgtcacaaaatag

SEQ ID NO: 69779 - DNA, 18 bp, synthetic construct
  source 1..18: mol_type = other DNA
ttatacgtctaacaaaag

SEQ ID NO: 69780 - DNA, 18 bp, synthetic construct
  source 1..18: mol_type = other DNA
ttatacgtttcattttag

SEQ ID NO: 69781 - DNA, 18 bp, synthetic construct
  source 1..18: mol_type = other DNA
ttatactacacagaacag

SEQ ID NO: 69782 - DNA, 18 bp, synthetic construct
  source 1..18: mol_type = other DNA
ttatactacactttatag

SEQ ID NO: 69783 - DNA, 18 bp, synthetic construct
  source 1..18: mol_type = other DNA
ttatactactcaattttg

SEQ ID NO: 69784 - DNA, 18 bp, synthetic construct
  source 1..18: mol_type = other DNA
ttatactatctactatag

SEQ ID NO: 69785 - DNA, 18 bp, synthetic construct
  source 1..18: mol_type = other DNA
ttatacttctcaaaatag

SEQ ID NO: 69786 - DNA, 18 bp, synthetic construct
  source 1..18: mol_type = other DNA
ttatacttttctctttag

SEQ ID NO: 69787 - DNA, 18 bp, synthetic construct
  source 1..18: mol_type = other DNA
ttatagcaatcactatgg

SEQ ID NO: 69788 - DNA, 18 bp, synthetic construct
  source 1..18: mol_type = other DNA
ttataggtctcattaatg

SEQ ID NO: 69789 - DNA, 18 bp, synthetic construct
  source 1..18: mol_type = other DNA
ttatataaatcactttag

SEQ ID NO: 69790 - DNA, 18 bp, synthetic construct
  source 1..18: mol_type = other DNA
ttatatgaatctcttttg

SEQ ID NO: 69791 - DNA, 18 bp, synthetic construct
  source 1..18: mol_type = other DNA
ttatatgacttaaaatag

SEQ ID NO: 69792 - DNA, 18 bp, synthetic construct
  source 1..18: mol_type = other DNA
ttatatgtctcacaacag

SEQ ID NO: 69793 - DNA, 18 bp, synthetic construct
  source 1..18: mol_type = other DNA
ttatcccaactagtatag

SEQ ID NO: 69794 - DNA, 18 bp, synthetic construct
  source 1..18: mol_type = other DNA
ttatccgacacagtttgg

SEQ ID NO: 69795 - DNA, 18 bp, synthetic construct
  source 1..18: mol_type = other DNA
ttatccgactctatattg

SEQ ID NO: 69796 - DNA, 18 bp, synthetic construct
  source 1..18: mol_type = other DNA
ttatccgacttagttttg

SEQ ID NO: 69797 - DNA, 18 bp, synthetic construct
  source 1..18: mol_type = other DNA
ttatccgtcactctatag

SEQ ID NO: 69798 - DNA, 18 bp, synthetic construct
  source 1..18: mol_type = other DNA
ttatccgtcttacaattg

SEQ ID NO: 69799 - DNA, 18 bp, synthetic construct
  source 1..18: mol_type = other DNA
ttatctaaatcacactag

SEQ ID NO: 69800 - DNA, 18 bp, synthetic construct
  source 1..18: mol_type = other DNA
ttatgatacatactgatg

SEQ ID NO: 69801 - DNA, 18 bp, synthetic construct
  source 1..18: mol_type = other DNA
ttatgcgactaaccctag

SEQ ID NO: 69802 - DNA, 18 bp, synthetic construct
  source 1..18: mol_type = other DNA
ttatgcgactcactgctg

SEQ ID NO: 69803 - DNA, 18 bp, synthetic construct
  source 1..18: mol_type = other DNA
ttatgcgtctcgctttag

SEQ ID NO: 69804 - DNA, 18 bp, synthetic construct
  source 1..18: mol_type = other DNA
ttatgcgtgttactttag

SEQ ID NO: 69805 - DNA, 18 bp, synthetic construct
  source 1..18: mol_type = other DNA
ttatgggactcacgctag

SEQ ID NO: 69806 - DNA, 18 bp, synthetic construct
  source 1..18: mol_type = other DNA
ttatgggactcacttaag

SEQ ID NO: 69807 - DNA, 18 bp, synthetic construct
  source 1..18: mol_type = other DNA
ttattagactatctattg

SEQ ID NO: 69808 - DNA, 18 bp, synthetic construct
  source 1..18: mol_type = other DNA
ttattcatctcacattag

SEQ ID NO: 69809 - DNA, 18 bp, synthetic construct
  source 1..18: mol_type = other DNA
ttattcatgtctcaatag

SEQ ID NO: 69810 - DNA, 18 bp, synthetic construct
  source 1..18: mol_type = other DNA
ttattcgaatcactaatg

SEQ ID NO: 69811 - DNA, 18 bp, synthetic construct
  source 1..18: mol_type = other DNA
ttattcgactaaccattg

SEQ ID NO: 69812 - DNA, 18 bp, synthetic construct
  source 1..18: mol_type = other DNA
ttattcgtctcaaaatag

SEQ ID NO: 69813 - DNA, 18 bp, synthetic construct
  source 1..18: mol_type = other DNA
ttattctaatcacaatag

SEQ ID NO: 69814 - DNA, 18 bp, synthetic construct
  source 1..18: mol_type = other DNA
ttattggacgcactaaag

SEQ ID NO: 69815 - DNA, 18 bp, synthetic construct
  source 1..18: mol_type = other DNA
ttattgttctcactatag

SEQ ID NO: 69816 - DNA, 18 bp, synthetic construct
  source 1..18: mol_type = other DNA
ttatttaattcattatcg

SEQ ID NO: 69817 - DNA, 18 bp, synthetic construct
  source 1..18: mol_type = other DNA
ttcaaggactctcctatg

SEQ ID NO: 69818 - DNA, 18 bp, synthetic construct
  source 1..18: mol_type = other DNA
ttcaccgattttctgttg

SEQ ID NO: 69819 - DNA, 18 bp, synthetic construct
  source 1..18: mol_type = other DNA
ttcatctattccctatag

SEQ ID NO: 69820 - DNA, 18 bp, synthetic construct
  source 1..18: mol_type = other DNA
ttccaccagttagtatag

SEQ ID NO: 69821 - DNA, 18 bp, synthetic construct
  source 1..18: mol_type = other DNA
ttctacctcctattatag

SEQ ID NO: 69822 - DNA, 18 bp, synthetic construct
  source 1..18: mol_type = other DNA
ttctacgtctcaatctag

SEQ ID NO: 69823 - DNA, 18 bp, synthetic construct
  source 1..18: mol_type = other DNA
ttctacgtctctctttag

SEQ ID NO: 69824 - DNA, 18 bp, synthetic construct
  source 1..18: mol_type = other DNA
ttctacgtcttacgagag

SEQ ID NO: 69825 - DNA, 18 bp, synthetic construct
  source 1..18: mol_type = other DNA
ttctactactcattaaag

SEQ ID NO: 69826 - DNA, 18 bp, synthetic construct
  source 1..18: mol_type = other DNA
ttgattggctcactttag

SEQ ID NO: 69827 - DNA, 18 bp, synthetic construct
  source 1..18: mol_type = other DNA
ttgtaccacttagaatag

SEQ ID NO: 69828 - DNA, 18 bp, synthetic construct
  source 1..18: mol_type = other DNA
ttgtacgaataactattg

SEQ ID NO: 69829 - DNA, 18 bp, synthetic construct
  source 1..18: mol_type = other DNA
ttgtacgatttattatag

SEQ ID NO: 69830 - DNA, 18 bp, synthetic construct
  source 1..18: mol_type = other DNA
ttgtacgtcaaatcattg

SEQ ID NO: 69831 - DNA, 18 bp, synthetic construct
  source 1..18: mol_type = other DNA
ttgtacgtcaatttctag

SEQ ID NO: 69832 - DNA, 18 bp, synthetic construct
  source 1..18: mol_type = other DNA
ttgtacgtctcacattag

SEQ ID NO: 69833 - DNA, 18 bp, synthetic construct
  source 1..18: mol_type = other DNA
ttgtactacttacaaaag

SEQ ID NO: 69834 - DNA, 18 bp, synthetic construct
  source 1..18: mol_type = other DNA
ttgtactgctctcaatgg

SEQ ID NO: 69835 - DNA, 18 bp, synthetic construct
  source 1..18: mol_type = other DNA
ttgtgcgtctcactaaag

SEQ ID NO: 69836 - DNA, 18 bp, synthetic construct
  source 1..18: mol_type = other DNA
ttgttctacactctattg

SEQ ID NO: 69837 - DNA, 18 bp, synthetic construct
  source 1..18: mol_type = other DNA
tttaacgactcaaaatgg

SEQ ID NO: 69838 - DNA, 18 bp, synthetic construct
  source 1..18: mol_type = other DNA
tttaacgtctaactatag

SEQ ID NO: 69839 - DNA, 18 bp, synthetic construct
  source 1..18: mol_type = other DNA
tttaccgtgtcaccgtag

SEQ ID NO: 69840 - DNA, 18 bp, synthetic construct
  source 1..18: mol_type = other DNA
tttcacgactctgtatag

SEQ ID NO: 69841 - DNA, 18 bp, synthetic construct
  source 1..18: mol_type = other DNA
tttggcgtcacactattg

SEQ ID NO: 69842 - DNA, 18 bp, synthetic construct
  source 1..18: mol_type = other DNA
tttgtctattcactaaag

SEQ ID NO: 69843 - DNA, 18 bp, synthetic construct
  source 1..18: mol_type = other DNA
ttttaaaactcagtatag

SEQ ID NO: 69844 - DNA, 18 bp, synthetic construct
  source 1..18: mol_type = other DNA
ttttaccactcacaaaag

SEQ ID NO: 69845 - DNA, 18 bp, synthetic construct
  source 1..18: mol_type = other DNA
ttttacctctcactttag

SEQ ID NO: 69846 - DNA, 18 bp, synthetic construct
  source 1..18: mol_type = other DNA
ttttacgacacacttaag

SEQ ID NO: 69847 - DNA, 18 bp, synthetic construct
  source 1..18: mol_type = other DNA
ttttacgacgcgctttag

SEQ ID NO: 69848 - DNA, 18 bp, synthetic construct
  source 1..18: mol_type = other DNA
ttttacgcctcgctatgg

SEQ ID NO: 69849 - DNA, 18 bp, synthetic construct
  source 1..18: mol_type = other DNA
ttttacgtcacaataaag

SEQ ID NO: 69850 - DNA, 18 bp, synthetic construct
  source 1..18: mol_type = other DNA
ttttacgtctcaaaatag

SEQ ID NO: 69851 - DNA, 18 bp, synthetic construct
  source 1..18: mol_type = other DNA
ttttacgtctcaaattag

SEQ ID NO: 69852 - DNA, 18 bp, synthetic construct
  source 1..18: mol_type = other DNA
ttttacgtttctctattg

SEQ ID NO: 69853 - DNA, 18 bp, synthetic construct
  source 1..18: mol_type = other DNA
ttttactcctcactactg

SEQ ID NO: 69854 - DNA, 18 bp, synthetic construct
  source 1..18: mol_type = other DNA
ttttagaaatcactatag

SEQ ID NO: 69855 - DNA, 18 bp, synthetic construct
  source 1..18: mol_type = other DNA
ttttccgactctcctttg

SEQ ID NO: 69856 - DNA, 18 bp, synthetic construct
  source 1..18: mol_type = other DNA
ttttgcgactatctatag

SEQ ID NO: 69857 - DNA, 18 bp, synthetic construct
  source 1..18: mol_type = other DNA
tttttcccctcactatag

SEQ ID NO: 69858 - DNA, 18 bp, synthetic construct
  source 1..18: mol_type = other DNA
aaagatgacatactaaag

SEQ ID NO: 69859 - DNA, 18 bp, synthetic construct
  source 1..18: mol_type = other DNA
atattcgtctcacaatag

SEQ ID NO: 69860 - DNA, 18 bp, synthetic construct
  source 1..18: mol_type = other DNA
taatacgattctcccgag

SEQ ID NO: 69861 - DNA, 18 bp, synthetic construct
  source 1..18: mol_type = other DNA
taatacgccacattcttg

SEQ ID NO: 69862 - DNA, 18 bp, synthetic construct
  source 1..18: mol_type = other DNA
taatattactcacttacg

SEQ ID NO: 69863 - DNA, 18 bp, synthetic construct
  source 1..18: mol_type = other DNA
taattcgacactctaatg

SEQ ID NO: 69864 - DNA, 18 bp, synthetic construct
  source 1..18: mol_type = other DNA
taattcgattcacaaatg

SEQ ID NO: 69865 - DNA, 18 bp, synthetic construct
  source 1..18: mol_type = other DNA
taattcgtctctatattg

SEQ ID NO: 69866 - DNA, 18 bp, synthetic construct
  source 1..18: mol_type = other DNA
tatcccgacttacaatag

SEQ ID NO: 69867 - DNA, 18 bp, synthetic construct
  source 1..18: mol_type = other DNA
tattacgacatgttcaag

SEQ ID NO: 69868 - DNA, 18 bp, synthetic construct
  source 1..18: mol_type = other DNA
tattacgtcaaactttag

SEQ ID NO: 69869 - DNA, 18 bp, synthetic construct
  source 1..18: mol_type = other DNA
tttaacgactcacgttag

SEQ ID NO: 69870 - DNA, 18 bp, synthetic construct
  source 1..18: mol_type = other DNA
taatccgacactgttcag

SEQ ID NO: 69871 - DNA, 18 bp, synthetic construct
  source 1..18: mol_type = other DNA
taattcgtttctcaatag

SEQ ID NO: 69872 - DNA, 18 bp, synthetic construct
  source 1..18: mol_type = other DNA
tattaaaactcacattag

SEQ ID NO: 69873 - DNA, 18 bp, synthetic construct
  source 1..18: mol_type = other DNA
tattacatcagactatag

SEQ ID NO: 69874 - DNA, 18 bp, synthetic construct
  source 1..18: mol_type = other DNA
tattacgactcgcttatg

SEQ ID NO: 69875 - DNA, 18 bp, synthetic construct
  source 1..18: mol_type = other DNA
tattacgtttcacttaag

SEQ ID NO: 69876 - DNA, 18 bp, synthetic construct
  source 1..18: mol_type = other DNA
ttaatctactcacaatag

SEQ ID NO: 69877 - DNA, 18 bp, synthetic construct
  source 1..18: mol_type = other DNA
ttatacgactctcacaag

SEQ ID NO: 69878 - DNA, 18 bp, synthetic construct
  source 1..18: mol_type = other DNA
ttattcgtctctcaatag

SEQ ID NO: 69879 - DNA, 18 bp, synthetic construct
  source 1..18: mol_type = other DNA
aaaaaagactcactgttg

SEQ ID NO: 69880 - DNA, 18 bp, synthetic construct
  source 1..18: mol_type = other DNA
aaaaacgacttcatatag

SEQ ID NO: 69881 - DNA, 18 bp, synthetic construct
  source 1..18: mol_type = other DNA
aaaaacgccacactattg

SEQ ID NO: 69882 - DNA, 18 bp, synthetic construct
  source 1..18: mol_type = other DNA
aaaaacggctctctacag

SEQ ID NO: 69883 - DNA, 18 bp, synthetic construct
  source 1..18: mol_type = other DNA
aaaaatgagtaaccatag

SEQ ID NO: 69884 - DNA, 18 bp, synthetic construct
  source 1..18: mol_type = other DNA
aaaatcaactctcaatag

SEQ ID NO: 69885 - DNA, 18 bp, synthetic construct
  source 1..18: mol_type = other DNA
aaaatcgaatcaccatag

SEQ ID NO: 69886 - DNA, 18 bp, synthetic construct
  source 1..18: mol_type = other DNA
aaacacgactctacattg

SEQ ID NO: 69887 - DNA, 18 bp, synthetic construct
  source 1..18: mol_type = other DNA
aaacactactcattctcg

SEQ ID NO: 69888 - DNA, 18 bp, synthetic construct
  source 1..18: mol_type = other DNA
aaagacatctcacaatag

SEQ ID NO: 69889 - DNA, 18 bp, synthetic construct
  source 1..18: mol_type = other DNA
aaataatactcgatatag

SEQ ID NO: 69890 - DNA, 18 bp, synthetic construct
  source 1..18: mol_type = other DNA
aaatacaactcacacttg

SEQ ID NO: 69891 - DNA, 18 bp, synthetic construct
  source 1..18: mol_type = other DNA
aaatacaatcgtctttag

SEQ ID NO: 69892 - DNA, 18 bp, synthetic construct
  source 1..18: mol_type = other DNA
aaatacatctcactaatg

SEQ ID NO: 69893 - DNA, 18 bp, synthetic construct
  source 1..18: mol_type = other DNA
aaataccactgctaatag

SEQ ID NO: 69894 - DNA, 18 bp, synthetic construct
  source 1..18: mol_type = other DNA
aaatacctctcaataatg

SEQ ID NO: 69895 - DNA, 18 bp, synthetic construct
  source 1..18: mol_type = other DNA
aaatacgacccagaacag

SEQ ID NO: 69896 - DNA, 18 bp, synthetic construct
  source 1..18: mol_type = other DNA
aaatacgactctttactg

SEQ ID NO: 69897 - DNA, 18 bp, synthetic construct
  source 1..18: mol_type = other DNA
aaatacgactgtttattg

SEQ ID NO: 69898 - DNA, 18 bp, synthetic construct
  source 1..18: mol_type = other DNA
aaatacgcccctcttgag

SEQ ID NO: 69899 - DNA, 18 bp, synthetic construct
  source 1..18: mol_type = other DNA
aaatacgtaaaacttaag

SEQ ID NO: 69900 - DNA, 18 bp, synthetic construct
  source 1..18: mol_type = other DNA
aaatacgtaactctatag

SEQ ID NO: 69901 - DNA, 18 bp, synthetic construct
  source 1..18: mol_type = other DNA
aaatacgtctctcttaag

SEQ ID NO: 69902 - DNA, 18 bp, synthetic construct
  source 1..18: mol_type = other DNA
aaatacgtttctcttaag

SEQ ID NO: 69903 - DNA, 18 bp, synthetic construct
  source 1..18: mol_type = other DNA
aaatactacacattttag

SEQ ID NO: 69904 - DNA, 18 bp, synthetic construct
  source 1..18: mol_type = other DNA
aaatactattcactcaag

SEQ ID NO: 69905 - DNA, 18 bp, synthetic construct
  source 1..18: mol_type = other DNA
aaatagaactaacgtagg

SEQ ID NO: 69906 - DNA, 18 bp, synthetic construct
  source 1..18: mol_type = other DNA
aaatatgacaccatgtag

SEQ ID NO: 69907 - DNA, 18 bp, synthetic construct
  source 1..18: mol_type = other DNA
aaatctgattccctttag

SEQ ID NO: 69908 - DNA, 18 bp, synthetic construct
  source 1..18: mol_type = other DNA
aaatgagtcttactttag

SEQ ID NO: 69909 - DNA, 18 bp, synthetic construct
  source 1..18: mol_type = other DNA
aaatgcaaccctctatcg

SEQ ID NO: 69910 - DNA, 18 bp, synthetic construct
  source 1..18: mol_type = other DNA
aaatgcaccacactacag

SEQ ID NO: 69911 - DNA, 18 bp, synthetic construct
  source 1..18: mol_type = other DNA
aaatgccactcactagtg

SEQ ID NO: 69912 - DNA, 18 bp, synthetic construct
  source 1..18: mol_type = other DNA
aaatgcgacatcctcaag

SEQ ID NO: 69913 - DNA, 18 bp, synthetic construct
  source 1..18: mol_type = other DNA
aaatgcgattcaggactg

SEQ ID NO: 69914 - DNA, 18 bp, synthetic construct
  source 1..18: mol_type = other DNA
aaatgcgtcacgctattg

SEQ ID NO: 69915 - DNA, 18 bp, synthetic construct
  source 1..18: mol_type = other DNA
aaatgtgacacactttag

SEQ ID NO: 69916 - DNA, 18 bp, synthetic construct
  source 1..18: mol_type = other DNA
aaattcgacacactactg

SEQ ID NO: 69917 - DNA, 18 bp, synthetic construct
  source 1..18: mol_type = other DNA
aaattcgaccctttttag

SEQ ID NO: 69918 - DNA, 18 bp, synthetic construct
  source 1..18: mol_type = other DNA
aaattcgtctcacaattg

SEQ ID NO: 69919 - DNA, 18 bp, synthetic construct
  source 1..18: mol_type = other DNA
aaattcgtcttacaattg

SEQ ID NO: 69920 - DNA, 18 bp, synthetic construct
  source 1..18: mol_type = other DNA
aaattctaatcactagtg

SEQ ID NO: 69921 - DNA, 18 bp, synthetic construct
  source 1..18: mol_type = other DNA
aaattctactctctaaag

SEQ ID NO: 69922 - DNA, 18 bp, synthetic construct
  source 1..18: mol_type = other DNA
aaatttgcctctctgaag

SEQ ID NO: 69923 - DNA, 18 bp, synthetic construct
  source 1..18: mol_type = other DNA
aacaacgaactcgtacag

SEQ ID NO: 69924 - DNA, 18 bp, synthetic construct
  source 1..18: mol_type = other DNA
aactaagacttacaatag

SEQ ID NO: 69925 - DNA, 18 bp, synthetic construct
  source 1..18: mol_type = other DNA
aactaccacccactttag

SEQ ID NO: 69926 - DNA, 18 bp, synthetic construct
  source 1..18: mol_type = other DNA
aagaacgactaactattg

SEQ ID NO: 69927 - DNA, 18 bp, synthetic construct
  source 1..18: mol_type = other DNA
aagtaagactcacattcg

SEQ ID NO: 69928 - DNA, 18 bp, synthetic construct
  source 1..18: mol_type = other DNA
aataacgactcacaattg

SEQ ID NO: 69929 - DNA, 18 bp, synthetic construct
  source 1..18: mol_type = other DNA
aataacgactcattctag

SEQ ID NO: 69930 - DNA, 18 bp, synthetic construct
  source 1..18: mol_type = other DNA
aatcacaactcagtattg

SEQ ID NO: 69931 - DNA, 18 bp, synthetic construct
  source 1..18: mol_type = other DNA
aatcacgtatacataaag

SEQ ID NO: 69932 - DNA, 18 bp, synthetic construct
  source 1..18: mol_type = other DNA
aatcccgactaactatag

SEQ ID NO: 69933 - DNA, 18 bp, synthetic construct
  source 1..18: mol_type = other DNA
aattacaattctctatag

SEQ ID NO: 69934 - DNA, 18 bp, synthetic construct
  source 1..18: mol_type = other DNA
aattaccaaacactatgg

SEQ ID NO: 69935 - DNA, 18 bp, synthetic construct
  source 1..18: mol_type = other DNA
aattacctctcacaatag

SEQ ID NO: 69936 - DNA, 18 bp, synthetic construct
  source 1..18: mol_type = other DNA
aattacgacacaccaaag

SEQ ID NO: 69937 - DNA, 18 bp, synthetic construct
  source 1..18: mol_type = other DNA
aattacgattagcgttag

SEQ ID NO: 69938 - DNA, 18 bp, synthetic construct
  source 1..18: mol_type = other DNA
aattactacccacaatag

SEQ ID NO: 69939 - DNA, 18 bp, synthetic construct
  source 1..18: mol_type = other DNA
aattactacttactctag

SEQ ID NO: 69940 - DNA, 18 bp, synthetic construct
  source 1..18: mol_type = other DNA
aattacttatcagtaatg

SEQ ID NO: 69941 - DNA, 18 bp, synthetic construct
  source 1..18: mol_type = other DNA
aattatcactcactgtag

SEQ ID NO: 69942 - DNA, 18 bp, synthetic construct
  source 1..18: mol_type = other DNA
aattatctcacactaaag

SEQ ID NO: 69943 - DNA, 18 bp, synthetic construct
  source 1..18: mol_type = other DNA
aattccagctcattatag

SEQ ID NO: 69944 - DNA, 18 bp, synthetic construct
  source 1..18: mol_type = other DNA
aatttcggcacactccag

SEQ ID NO: 69945 - DNA, 18 bp, synthetic construct
  source 1..18: mol_type = other DNA
acataagtttcaccacag

SEQ ID NO: 69946 - DNA, 18 bp, synthetic construct
  source 1..18: mol_type = other DNA
acatacaacttactgtag

SEQ ID NO: 69947 - DNA, 18 bp, synthetic construct
  source 1..18: mol_type = other DNA
acatacttctctctatag

SEQ ID NO: 69948 - DNA, 18 bp, synthetic construct
  source 1..18: mol_type = other DNA
acatccgactcactaacg

SEQ ID NO: 69949 - DNA, 18 bp, synthetic construct
  source 1..18: mol_type = other DNA
actcccgacacactatag

SEQ ID NO: 69950 - DNA, 18 bp, synthetic construct
  source 1..18: mol_type = other DNA
acttacgactccctttcg

SEQ ID NO: 69951 - DNA, 18 bp, synthetic construct
  source 1..18: mol_type = other DNA
agatacaactcagtcaag

SEQ ID NO: 69952 - DNA, 18 bp, synthetic construct
  source 1..18: mol_type = other DNA
agatacgaatctcataag

SEQ ID NO: 69953 - DNA, 18 bp, synthetic construct
  source 1..18: mol_type = other DNA
agatacgcctcactcatg

SEQ ID NO: 69954 - DNA, 18 bp, synthetic construct
  source 1..18: mol_type = other DNA
agatccgtcaccctattg

SEQ ID NO: 69955 - DNA, 18 bp, synthetic construct
  source 1..18: mol_type = other DNA
agatgcatttctctttag

SEQ ID NO: 69956 - DNA, 18 bp, synthetic construct
  source 1..18: mol_type = other DNA
aggtacgacttactttag

SEQ ID NO: 69957 - DNA, 18 bp, synthetic construct
  source 1..18: mol_type = other DNA
agttgccactcactaaag

SEQ ID NO: 69958 - DNA, 18 bp, synthetic construct
  source 1..18: mol_type = other DNA
ataaacaactcattaaag

SEQ ID NO: 69959 - DNA, 18 bp, synthetic construct
  source 1..18: mol_type = other DNA
ataaacacctctctatag

SEQ ID NO: 69960 - DNA, 18 bp, synthetic construct
  source 1..18: mol_type = other DNA
ataaacgattcaccatag

SEQ ID NO: 69961 - DNA, 18 bp, synthetic construct
  source 1..18: mol_type = other DNA
ataaaggacttaatttag

SEQ ID NO: 69962 - DNA, 18 bp, synthetic construct
  source 1..18: mol_type = other DNA
ataatcgactctctattg

SEQ ID NO: 69963 - DNA, 18 bp, synthetic construct
  source 1..18: mol_type = other DNA
atagacttctcactatag

SEQ ID NO: 69964 - DNA, 18 bp, synthetic construct
  source 1..18: mol_type = other DNA
atataagatacactctag

SEQ ID NO: 69965 - DNA, 18 bp, synthetic construct
  source 1..18: mol_type = other DNA
atataagccccattattg

SEQ ID NO: 69966 - DNA, 18 bp, synthetic construct
  source 1..18: mol_type = other DNA
atatacaactcatgatag

SEQ ID NO: 69967 - DNA, 18 bp, synthetic construct
  source 1..18: mol_type = other DNA
atatacatcacacaatag

SEQ ID NO: 69968 - DNA, 18 bp, synthetic construct
  source 1..18: mol_type = other DNA
atatacgaaacattattg

SEQ ID NO: 69969 - DNA, 18 bp, synthetic construct
  source 1..18: mol_type = other DNA
atatacgacttacttttg

SEQ ID NO: 69970 - DNA, 18 bp, synthetic construct
  source 1..18: mol_type = other DNA
atatacgcttcagtatag

SEQ ID NO: 69971 - DNA, 18 bp, synthetic construct
  source 1..18: mol_type = other DNA
atatacgtaccaccatag

SEQ ID NO: 69972 - DNA, 18 bp, synthetic construct
  source 1..18: mol_type = other DNA
atatacgtttcccattag

SEQ ID NO: 69973 - DNA, 18 bp, synthetic construct
  source 1..18: mol_type = other DNA
atatacgtttgtttatgg

SEQ ID NO: 69974 - DNA, 18 bp, synthetic construct
  source 1..18: mol_type = other DNA
atatacgttttatcatag

SEQ ID NO: 69975 - DNA, 18 bp, synthetic construct
  source 1..18: mol_type = other DNA
atatactaaacacattag

SEQ ID NO: 69976 - DNA, 18 bp, synthetic construct
  source 1..18: mol_type = other DNA
atatactacttattacag

SEQ ID NO: 69977 - DNA, 18 bp, synthetic construct
  source 1..18: mol_type = other DNA
atatactattcactttag

SEQ ID NO: 69978 - DNA, 18 bp, synthetic construct
  source 1..18: mol_type = other DNA
atatagatttcactatag

SEQ ID NO: 69979 - DNA, 18 bp, synthetic construct
  source 1..18: mol_type = other DNA
atatagtaatcactctag

SEQ ID NO: 69980 - DNA, 18 bp, synthetic construct
  source 1..18: mol_type = other DNA
atatatgtctcactattg

SEQ ID NO: 69981 - DNA, 18 bp, synthetic construct
  source 1..18: mol_type = other DNA
atatcccattcactatag

SEQ ID NO: 69982 - DNA, 18 bp, synthetic construct
  source 1..18: mol_type = other DNA
atatcctaatcactattg

SEQ ID NO: 69983 - DNA, 18 bp, synthetic construct
  source 1..18: mol_type = other DNA
atatgcgattcccttgag

SEQ ID NO: 69984 - DNA, 18 bp, synthetic construct
  source 1..18: mol_type = other DNA
atattcgcctctccattg

SEQ ID NO: 69985 - DNA, 18 bp, synthetic construct
  source 1..18: mol_type = other DNA
atgtacgactcactagtg

SEQ ID NO: 69986 - DNA, 18 bp, synthetic construct
  source 1..18: mol_type = other DNA
atgtacgactctctgtag

SEQ ID NO: 69987 - DNA, 18 bp, synthetic construct
  source 1..18: mol_type = other DNA
atgtacgagtccctattg

SEQ ID NO: 69988 - DNA, 18 bp, synthetic construct
  source 1..18: mol_type = other DNA
atgtactactcactaaag

SEQ ID NO: 69989 - DNA, 18 bp, synthetic construct
  source 1..18: mol_type = other DNA
attaacctttctctattg

SEQ ID NO: 69990 - DNA, 18 bp, synthetic construct
  source 1..18: mol_type = other DNA
attaccaactcactatag

SEQ ID NO: 69991 - DNA, 18 bp, synthetic construct
  source 1..18: mol_type = other DNA
attcactatactgtatag

SEQ ID NO: 69992 - DNA, 18 bp, synthetic construct
  source 1..18: mol_type = other DNA
atttaattctcactttcg

SEQ ID NO: 69993 - DNA, 18 bp, synthetic construct
  source 1..18: mol_type = other DNA
atttaccagtcactatag

SEQ ID NO: 69994 - DNA, 18 bp, synthetic construct
  source 1..18: mol_type = other DNA
atttactactcaatatag

SEQ ID NO: 69995 - DNA, 18 bp, synthetic construct
  source 1..18: mol_type = other DNA
atttacttctcaatgtag

SEQ ID NO: 69996 - DNA, 18 bp, synthetic construct
  source 1..18: mol_type = other DNA
atttcggatttacaacag

SEQ ID NO: 69997 - DNA, 18 bp, synthetic construct
  source 1..18: mol_type = other DNA
caaaacgactatctattg

SEQ ID NO: 69998 - DNA, 18 bp, synthetic construct
  source 1..18: mol_type = other DNA
caaaacgtctctaaatag

SEQ ID NO: 69999 - DNA, 18 bp, synthetic construct
  source 1..18: mol_type = other DNA
caaaactactcgacattg

SEQ ID NO: 70000 - DNA, 18 bp, synthetic construct
  source 1..18: mol_type = other DNA
caaaatgactcgatatag

SEQ ID NO: 70001 - DNA, 18 bp, synthetic construct
  source 1..18: mol_type = other DNA
caaaatgtatcactatag

SEQ ID NO: 70002 - DNA, 18 bp, synthetic construct
  source 1..18: mol_type = other DNA
caaatagactcaccttag

SEQ ID NO: 70003 - DNA, 18 bp, synthetic construct
  source 1..18: mol_type = other DNA
caacattactcacaattg

SEQ ID NO: 70004 - DNA, 18 bp, synthetic construct
  source 1..18: mol_type = other DNA
caataagactcactgctg

SEQ ID NO: 70005 - DNA, 18 bp, synthetic construct
  source 1..18: mol_type = other DNA
caataagtctctctattg

SEQ ID NO: 70006 - DNA, 18 bp, synthetic construct
  source 1..18: mol_type = other DNA
caataatactcacaatcg

SEQ ID NO: 70007 - DNA, 18 bp, synthetic construct
  source 1..18: mol_type = other DNA
caatacaatccattatag

SEQ ID NO: 70008 - DNA, 18 bp, synthetic construct
  source 1..18: mol_type = other DNA
caatacatataactatag

SEQ ID NO: 70009 - DNA, 18 bp, synthetic construct
  source 1..18: mol_type = other DNA
caataccacacaccttag

SEQ ID NO: 70010 - DNA, 18 bp, synthetic construct
  source 1..18: mol_type = other DNA
caatacgactcacatatg

SEQ ID NO: 70011 - DNA, 18 bp, synthetic construct
  source 1..18: mol_type = other DNA
caatacgcttcgcatttg

SEQ ID NO: 70012 - DNA, 18 bp, synthetic construct
  source 1..18: mol_type = other DNA
caatactattctcaattg

SEQ ID NO: 70013 - DNA, 18 bp, synthetic construct
  source 1..18: mol_type = other DNA
caatactcatcactaaag

SEQ ID NO: 70014 - DNA, 18 bp, synthetic construct
  source 1..18: mol_type = other DNA
caatactgctcacaatcg

SEQ ID NO: 70015 - DNA, 18 bp, synthetic construct
  source 1..18: mol_type = other DNA
caatatgacccgccatag

SEQ ID NO: 70016 - DNA, 18 bp, synthetic construct
  source 1..18: mol_type = other DNA
caatccgagagtatatag

SEQ ID NO: 70017 - DNA, 18 bp, synthetic construct
  source 1..18: mol_type = other DNA
caatgggactctgtatag

SEQ ID NO: 70018 - DNA, 18 bp, synthetic construct
  source 1..18: mol_type = other DNA
caattcgactaggtatgg

SEQ ID NO: 70019 - DNA, 18 bp, synthetic construct
  source 1..18: mol_type = other DNA
caattcgtctctctattg

SEQ ID NO: 70020 - DNA, 18 bp, synthetic construct
  source 1..18: mol_type = other DNA
caattggcctcgctttag

SEQ ID NO: 70021 - DNA, 18 bp, synthetic construct
  source 1..18: mol_type = other DNA
caatttgtctcactaaag

SEQ ID NO: 70022 - DNA, 18 bp, synthetic construct
  source 1..18: mol_type = other DNA
cacatcgactcactaaag

SEQ ID NO: 70023 - DNA, 18 bp, synthetic construct
  source 1..18: mol_type = other DNA
cactacgtctcacttaag

SEQ ID NO: 70024 - DNA, 18 bp, synthetic construct
  source 1..18: mol_type = other DNA
cactaggactcattattg

SEQ ID NO: 70025 - DNA, 18 bp, synthetic construct
  source 1..18: mol_type = other DNA
cagtcagactcaggatag

SEQ ID NO: 70026 - DNA, 18 bp, synthetic construct
  source 1..18: mol_type = other DNA
cattacgacttactcaag

SEQ ID NO: 70027 - DNA, 18 bp, synthetic construct
  source 1..18: mol_type = other DNA
cattacgtcacaccatag

SEQ ID NO: 70028 - DNA, 18 bp, synthetic construct
  source 1..18: mol_type = other DNA
cattactaattaatattg

SEQ ID NO: 70029 - DNA, 18 bp, synthetic construct
  source 1..18: mol_type = other DNA
cgataggacacattgaag

SEQ ID NO: 70030 - DNA, 18 bp, synthetic construct
  source 1..18: mol_type = other DNA
cgatatgaatctcaatag

SEQ ID NO: 70031 - DNA, 18 bp, synthetic construct
  source 1..18: mol_type = other DNA
cgattcgactcatttttg

SEQ ID NO: 70032 - DNA, 18 bp, synthetic construct
  source 1..18: mol_type = other DNA
cgatttgacgcactattg

SEQ ID NO: 70033 - DNA, 18 bp, synthetic construct
  source 1..18: mol_type = other DNA
ctaaacgactcagcatag

SEQ ID NO: 70034 - DNA, 18 bp, synthetic construct
  source 1..18: mol_type = other DNA
ctaaatttcactattccg

SEQ ID NO: 70035 - DNA, 18 bp, synthetic construct
  source 1..18: mol_type = other DNA
ctagaagacttagtatag

SEQ ID NO: 70036 - DNA, 18 bp, synthetic construct
  source 1..18: mol_type = other DNA
ctatacgtctcacattag

SEQ ID NO: 70037 - DNA, 18 bp, synthetic construct
  source 1..18: mol_type = other DNA
ctatacgtctccatatag

SEQ ID NO: 70038 - DNA, 18 bp, synthetic construct
  source 1..18: mol_type = other DNA
ctatactattctcaatag

SEQ ID NO: 70039 - DNA, 18 bp, synthetic construct
  source 1..18: mol_type = other DNA
ctataggactcagtcaag

SEQ ID NO: 70040 - DNA, 18 bp, synthetic construct
  source 1..18: mol_type = other DNA
ctatgcatcttcctatag

SEQ ID NO: 70041 - DNA, 18 bp, synthetic construct
  source 1..18: mol_type = other DNA
ctatgcggctctctatag

SEQ ID NO: 70042 - DNA, 18 bp, synthetic construct
  source 1..18: mol_type = other DNA
ctcttatacacactatag

SEQ ID NO: 70043 - DNA, 18 bp, synthetic construct
  source 1..18: mol_type = other DNA
ctttacgacacacaatag

SEQ ID NO: 70044 - DNA, 18 bp, synthetic construct
  source 1..18: mol_type = other DNA
gaacacgactcccattag

SEQ ID NO: 70045 - DNA, 18 bp, synthetic construct
  source 1..18: mol_type = other DNA
gaatacaacacgcaaaag

SEQ ID NO: 70046 - DNA, 18 bp, synthetic construct
  source 1..18: mol_type = other DNA
gaatacagctcattctag

SEQ ID NO: 70047 - DNA, 18 bp, synthetic construct
  source 1..18: mol_type = other DNA
gaatacgtctgattattg

SEQ ID NO: 70048 - DNA, 18 bp, synthetic construct
  source 1..18: mol_type = other DNA
gaatagtactcaatgtag

SEQ ID NO: 70049 - DNA, 18 bp, synthetic construct
  source 1..18: mol_type = other DNA
gaattagtcagactatag

SEQ ID NO: 70050 - DNA, 18 bp, synthetic construct
  source 1..18: mol_type = other DNA
gaattcgacacacaatgg

SEQ ID NO: 70051 - DNA, 18 bp, synthetic construct
  source 1..18: mol_type = other DNA
gaatttgtctcactcaag

SEQ ID NO: 70052 - DNA, 18 bp, synthetic construct
  source 1..18: mol_type = other DNA
gagcacgaatcactaaaa

SEQ ID NO: 70053 - DNA, 18 bp, synthetic construct
  source 1..18: mol_type = other DNA
gataacgcctcactgtag

SEQ ID NO: 70054 - DNA, 18 bp, synthetic construct
  source 1..18: mol_type = other DNA
gatcacgactcgctttag

SEQ ID NO: 70055 - DNA, 18 bp, synthetic construct
  source 1..18: mol_type = other DNA
gattaggacccactattg

SEQ ID NO: 70056 - DNA, 18 bp, synthetic construct
  source 1..18: mol_type = other DNA
gcatactactcaacatag

SEQ ID NO: 70057 - DNA, 18 bp, synthetic construct
  source 1..18: mol_type = other DNA
gtatacatccctgtgtag

SEQ ID NO: 70058 - DNA, 18 bp, synthetic construct
  source 1..18: mol_type = other DNA
gtatacgacacattcaag

SEQ ID NO: 70059 - DNA, 18 bp, synthetic construct
  source 1..18: mol_type = other DNA
gtatacgattcacaattg

SEQ ID NO: 70060 - DNA, 18 bp, synthetic construct
  source 1..18: mol_type = other DNA
gtatacttataacaatag

SEQ ID NO: 70061 - DNA, 18 bp, synthetic construct
  source 1..18: mol_type = other DNA
gtattcgattcaatatag

SEQ ID NO: 70062 - DNA, 18 bp, synthetic construct
  source 1..18: mol_type = other DNA
gtttacgacccactttag

SEQ ID NO: 70063 - DNA, 18 bp, synthetic construct
  source 1..18: mol_type = other DNA
taaaaactcttactaaag

SEQ ID NO: 70064 - DNA, 18 bp, synthetic construct
  source 1..18: mol_type = other DNA
taaaaagacacattacag

SEQ ID NO: 70065 - DNA, 18 bp, synthetic construct
  source 1..18: mol_type = other DNA
taaaaagtcttacttcag

SEQ ID NO: 70066 - DNA, 18 bp, synthetic construct
  source 1..18: mol_type = other DNA
taaaacaactgcccatag

SEQ ID NO: 70067 - DNA, 18 bp, synthetic construct
  source 1..18: mol_type = other DNA
taaaacatcactctaaag

SEQ ID NO: 70068 - DNA, 18 bp, synthetic construct
  source 1..18: mol_type = other DNA
taaaacctatcactttag

SEQ ID NO: 70069 - DNA, 18 bp, synthetic construct
  source 1..18: mol_type = other DNA
taaaacgaatcgcaaaag

SEQ ID NO: 70070 - DNA, 18 bp, synthetic construct
  source 1..18: mol_type = other DNA
taaaacgaatcttgttag

SEQ ID NO: 70071 - DNA, 18 bp, synthetic construct
  source 1..18: mol_type = other DNA
taaaacgacttgcactag

SEQ ID NO: 70072 - DNA, 18 bp, synthetic construct
  source 1..18: mol_type = other DNA
taaaacgatacacattgg

SEQ ID NO: 70073 - DNA, 18 bp, synthetic construct
  source 1..18: mol_type = other DNA
taaaacgattatctaaag

SEQ ID NO: 70074 - DNA, 18 bp, synthetic construct
  source 1..18: mol_type = other DNA
taaaacggatctcgaaag

SEQ ID NO: 70075 - DNA, 18 bp, synthetic construct
  source 1..18: mol_type = other DNA
taaaacgtcacaaagtcg

SEQ ID NO: 70076 - DNA, 18 bp, synthetic construct
  source 1..18: mol_type = other DNA
taaaacgtctgatatttg

SEQ ID NO: 70077 - DNA, 18 bp, synthetic construct
  source 1..18: mol_type = other DNA
taaaacgtcttacagtag

SEQ ID NO: 70078 - DNA, 18 bp, synthetic construct
  source 1..18: mol_type = other DNA
taaaacgtttcataatag

SEQ ID NO: 70079 - DNA, 18 bp, synthetic construct
  source 1..18: mol_type = other DNA
taaaacgttttactgtag

SEQ ID NO: 70080 - DNA, 18 bp, synthetic construct
  source 1..18: mol_type = other DNA
taaaactaaactttattg

SEQ ID NO: 70081 - DNA, 18 bp, synthetic construct
  source 1..18: mol_type = other DNA
taaaactattcactaccg

SEQ ID NO: 70082 - DNA, 18 bp, synthetic construct
  source 1..18: mol_type = other DNA
taaaatgactaacttaag

SEQ ID NO: 70083 - DNA, 18 bp, synthetic construct
  source 1..18: mol_type = other DNA
taaaatgcctcactactg

SEQ ID NO: 70084 - DNA, 18 bp, synthetic construct
  source 1..18: mol_type = other DNA
taaaatgtatcactgaag

SEQ ID NO: 70085 - DNA, 18 bp, synthetic construct
  source 1..18: mol_type = other DNA
taaaattactgacaatag

SEQ ID NO: 70086 - DNA, 18 bp, synthetic construct
  source 1..18: mol_type = other DNA
taaacacagacactttag

SEQ ID NO: 70087 - DNA, 18 bp, synthetic construct
  source 1..18: mol_type = other DNA
taaaccaacttactacag

SEQ ID NO: 70088 - DNA, 18 bp, synthetic construct
  source 1..18: mol_type = other DNA
taaaccgactatgtgtcg

SEQ ID NO: 70089 - DNA, 18 bp, synthetic construct
  source 1..18: mol_type = other DNA
taaaccttctaagtatag

SEQ ID NO: 70090 - DNA, 18 bp, synthetic construct
  source 1..18: mol_type = other DNA
taaagatacacaatagag

SEQ ID NO: 70091 - DNA, 18 bp, synthetic construct
  source 1..18: mol_type = other DNA
taaagcgactcaaattag

SEQ ID NO: 70092 - DNA, 18 bp, synthetic construct
  source 1..18: mol_type = other DNA
taaagtcactcaatatag

SEQ ID NO: 70093 - DNA, 18 bp, synthetic construct
  source 1..18: mol_type = other DNA
taaataatcccactaaag

SEQ ID NO: 70094 - DNA, 18 bp, synthetic construct
  source 1..18: mol_type = other DNA
taaatcgacactttatag

SEQ ID NO: 70095 - DNA, 18 bp, synthetic construct
  source 1..18: mol_type = other DNA
taaatcgactctttttag

SEQ ID NO: 70096 - DNA, 18 bp, synthetic construct
  source 1..18: mol_type = other DNA
taaatcgacttacttcag

SEQ ID NO: 70097 - DNA, 18 bp, synthetic construct
  source 1..18: mol_type = other DNA
taacaatacttactattg

SEQ ID NO: 70098 - DNA, 18 bp, synthetic construct
  source 1..18: mol_type = other DNA
taacacaactgcctttag

SEQ ID NO: 70099 - DNA, 18 bp, synthetic construct
  source 1..18: mol_type = other DNA
taacacaagtaattatgg

SEQ ID NO: 70100 - DNA, 18 bp, synthetic construct
  source 1..18: mol_type = other DNA
taacacgacaaacttcag

SEQ ID NO: 70101 - DNA, 18 bp, synthetic construct
  source 1..18: mol_type = other DNA
taacacgagtccataatg

SEQ ID NO: 70102 - DNA, 18 bp, synthetic construct
  source 1..18: mol_type = other DNA
taacactaataacagtag

SEQ ID NO: 70103 - DNA, 18 bp, synthetic construct
  source 1..18: mol_type = other DNA
taacactactatttatag

SEQ ID NO: 70104 - DNA, 18 bp, synthetic construct
  source 1..18: mol_type = other DNA
taacaggactcacagttg

SEQ ID NO: 70105 - DNA, 18 bp, synthetic construct
  source 1..18: mol_type = other DNA
taacatcaaacacaatag

SEQ ID NO: 70106 - DNA, 18 bp, synthetic construct
  source 1..18: mol_type = other DNA
taacatctctcacaatag

SEQ ID NO: 70107 - DNA, 18 bp, synthetic construct
  source 1..18: mol_type = other DNA
taacatgtcccactttag

SEQ ID NO: 70108 - DNA, 18 bp, synthetic construct
  source 1..18: mol_type = other DNA
taacccgtataactttag

SEQ ID NO: 70109 - DNA, 18 bp, synthetic construct
  source 1..18: mol_type = other DNA
taactcaactcatgctag

SEQ ID NO: 70110 - DNA, 18 bp, synthetic construct
  source 1..18: mol_type = other DNA
taactcgatacattaaag

SEQ ID NO: 70111 - DNA, 18 bp, synthetic construct
  source 1..18: mol_type = other DNA
taactcgtctcactcttg

SEQ ID NO: 70112 - DNA, 18 bp, synthetic construct
  source 1..18: mol_type = other DNA
taactcgtctcactttcg

SEQ ID NO: 70113 - DNA, 18 bp, synthetic construct
  source 1..18: mol_type = other DNA
taagacgacgtaccaatg

SEQ ID NO: 70114 - DNA, 18 bp, synthetic construct
  source 1..18: mol_type = other DNA
taagagtacagaatgaag

SEQ ID NO: 70115 - DNA, 18 bp, synthetic construct
  source 1..18: mol_type = other DNA
taagtcgaatcactaatg

SEQ ID NO: 70116 - DNA, 18 bp, synthetic construct
  source 1..18: mol_type = other DNA
taagtcgtaagtcaattg

SEQ ID NO: 70117 - DNA, 18 bp, synthetic construct
  source 1..18: mol_type = other DNA
taataaaactatctcaag

SEQ ID NO: 70118 - DNA, 18 bp, synthetic construct
  source 1..18: mol_type = other DNA
taataaatcccactaaag

SEQ ID NO: 70119 - DNA, 18 bp, synthetic construct
  source 1..18: mol_type = other DNA
taataagaataccaaaag

SEQ ID NO: 70120 - DNA, 18 bp, synthetic construct
  source 1..18: mol_type = other DNA
taataagacttacttatg

SEQ ID NO: 70121 - DNA, 18 bp, synthetic construct
  source 1..18: mol_type = other DNA
taataaggcttacaaacg

SEQ ID NO: 70122 - DNA, 18 bp, synthetic construct
  source 1..18: mol_type = other DNA
taataagtcacacatttg

SEQ ID NO: 70123 - DNA, 18 bp, synthetic construct
  source 1..18: mol_type = other DNA
taataagtcatactttag

SEQ ID NO: 70124 - DNA, 18 bp, synthetic construct
  source 1..18: mol_type = other DNA
taataatacttattgtag

SEQ ID NO: 70125 - DNA, 18 bp, synthetic construct
  source 1..18: mol_type = other DNA
taatacaactttcattag

SEQ ID NO: 70126 - DNA, 18 bp, synthetic construct
  source 1..18: mol_type = other DNA
taatacacatcagtgtag

SEQ ID NO: 70127 - DNA, 18 bp, synthetic construct
  source 1..18: mol_type = other DNA
taatacatcatacaatag

SEQ ID NO: 70128 - DNA, 18 bp, synthetic construct
  source 1..18: mol_type = other DNA
taatacatgtcgctttag

SEQ ID NO: 70129 - DNA, 18 bp, synthetic construct
  source 1..18: mol_type = other DNA
taatacatttcacattcg

SEQ ID NO: 70130 - DNA, 18 bp, synthetic construct
  source 1..18: mol_type = other DNA
taatacatttcaccccag

SEQ ID NO: 70131 - DNA, 18 bp, synthetic construct
  source 1..18: mol_type = other DNA
taatacatttcactaacg

SEQ ID NO: 70132 - DNA, 18 bp, synthetic construct
  source 1..18: mol_type = other DNA
taataccaatatatatag

SEQ ID NO: 70133 - DNA, 18 bp, synthetic construct
  source 1..18: mol_type = other DNA
taataccactctacattg

SEQ ID NO: 70134 - DNA, 18 bp, synthetic construct
  source 1..18: mol_type = other DNA
taataccatacaccattg

SEQ ID NO: 70135 - DNA, 18 bp, synthetic construct
  source 1..18: mol_type = other DNA
taataccatatacaattg

SEQ ID NO: 70136 - DNA, 18 bp, synthetic construct
  source 1..18: mol_type = other DNA
taataccattccatttag

SEQ ID NO: 70137 - DNA, 18 bp, synthetic construct
  source 1..18: mol_type = other DNA
taataccccatacaattg

SEQ ID NO: 70138 - DNA, 18 bp, synthetic construct
  source 1..18: mol_type = other DNA
taataccgcccactctcg

SEQ ID NO: 70139 - DNA, 18 bp, synthetic construct
  source 1..18: mol_type = other DNA
taatacctctcacggcag

SEQ ID NO: 70140 - DNA, 18 bp, synthetic construct
  source 1..18: mol_type = other DNA
taatacctcttattaaag

SEQ ID NO: 70141 - DNA, 18 bp, synthetic construct
  source 1..18: mol_type = other DNA
taatacgaattattaatg

SEQ ID NO: 70142 - DNA, 18 bp, synthetic construct
  source 1..18: mol_type = other DNA
taatacgacacccaaacg

SEQ ID NO: 70143 - DNA, 18 bp, synthetic construct
  source 1..18: mol_type = other DNA
taatacgacactttttgg

SEQ ID NO: 70144 - DNA, 18 bp, synthetic construct
  source 1..18: mol_type = other DNA
taatacgacagccaattg

SEQ ID NO: 70145 - DNA, 18 bp, synthetic construct
  source 1..18: mol_type = other DNA
taatacgacatgcattag

SEQ ID NO: 70146 - DNA, 18 bp, synthetic construct
  source 1..18: mol_type = other DNA
taatacgaccttatctag

SEQ ID NO: 70147 - DNA, 18 bp, synthetic construct
  source 1..18: mol_type = other DNA
taatacgactcatatatg

SEQ ID NO: 70148 - DNA, 18 bp, synthetic construct
  source 1..18: mol_type = other DNA
taatacgactttcttacg

SEQ ID NO: 70149 - DNA, 18 bp, synthetic construct
  source 1..18: mol_type = other DNA
taatacgacttttttttg

SEQ ID NO: 70150 - DNA, 18 bp, synthetic construct
  source 1..18: mol_type = other DNA
taatacgagctacactag

SEQ ID NO: 70151 - DNA, 18 bp, synthetic construct
  source 1..18: mol_type = other DNA
taatacgagcttcatctg

SEQ ID NO: 70152 - DNA, 18 bp, synthetic construct
  source 1..18: mol_type = other DNA
taatacgcaagtctattg

SEQ ID NO: 70153 - DNA, 18 bp, synthetic construct
  source 1..18: mol_type = other DNA
taatacgccgacatatag

SEQ ID NO: 70154 - DNA, 18 bp, synthetic construct
  source 1..18: mol_type = other DNA
taatacgccttatataag

SEQ ID NO: 70155 - DNA, 18 bp, synthetic construct
  source 1..18: mol_type = other DNA
taatacgcttgaatattg

SEQ ID NO: 70156 - DNA, 18 bp, synthetic construct
  source 1..18: mol_type = other DNA
taatacggctatctaatg

SEQ ID NO: 70157 - DNA, 18 bp, synthetic construct
  source 1..18: mol_type = other DNA
taatacggtgcattaatg

SEQ ID NO: 70158 - DNA, 18 bp, synthetic construct
  source 1..18: mol_type = other DNA
taatacgtcccaacattg

SEQ ID NO: 70159 - DNA, 18 bp, synthetic construct
  source 1..18: mol_type = other DNA
taatacgtcctatcatag

SEQ ID NO: 70160 - DNA, 18 bp, synthetic construct
  source 1..18: mol_type = other DNA
taatacgtctgacctttg

SEQ ID NO: 70161 - DNA, 18 bp, synthetic construct
  source 1..18: mol_type = other DNA
taatactaatgatttttg

SEQ ID NO: 70162 - DNA, 18 bp, synthetic construct
  source 1..18: mol_type = other DNA
taatacttcaaaccatag

SEQ ID NO: 70163 - DNA, 18 bp, synthetic construct
  source 1..18: mol_type = other DNA
taatactttacactaaag

SEQ ID NO: 70164 - DNA, 18 bp, synthetic construct
  source 1..18: mol_type = other DNA
taatacttttcacttaag

SEQ ID NO: 70165 - DNA, 18 bp, synthetic construct
  source 1..18: mol_type = other DNA
taataggaatctcaattg

SEQ ID NO: 70166 - DNA, 18 bp, synthetic construct
  source 1..18: mol_type = other DNA
taataggcctgaaaattg

SEQ ID NO: 70167 - DNA, 18 bp, synthetic construct
  source 1..18: mol_type = other DNA
taataggtctcacatatg

SEQ ID NO: 70168 - DNA, 18 bp, synthetic construct
  source 1..18: mol_type = other DNA
taataggtctcccaattg

SEQ ID NO: 70169 - DNA, 18 bp, synthetic construct
  source 1..18: mol_type = other DNA
taataggtcttaccttag

SEQ ID NO: 70170 - DNA, 18 bp, synthetic construct
  source 1..18: mol_type = other DNA
taataggtttcataatag

SEQ ID NO: 70171 - DNA, 18 bp, synthetic construct
  source 1..18: mol_type = other DNA
taatataactctcgaagg

SEQ ID NO: 70172 - DNA, 18 bp, synthetic construct
  source 1..18: mol_type = other DNA
taatatgaaacgcgattg

SEQ ID NO: 70173 - DNA, 18 bp, synthetic construct
  source 1..18: mol_type = other DNA
taatatgattttttatag

SEQ ID NO: 70174 - DNA, 18 bp, synthetic construct
  source 1..18: mol_type = other DNA
taatattaagctctatag

SEQ ID NO: 70175 - DNA, 18 bp, synthetic construct
  source 1..18: mol_type = other DNA
taatattactcagtgttg

SEQ ID NO: 70176 - DNA, 18 bp, synthetic construct
  source 1..18: mol_type = other DNA
taatatttctctccatag

SEQ ID NO: 70177 - DNA, 18 bp, synthetic construct
  source 1..18: mol_type = other DNA
taatatttcttacttaag

SEQ ID NO: 70178 - DNA, 18 bp, synthetic construct
  source 1..18: mol_type = other DNA
taatcaatctgtctatag

SEQ ID NO: 70179 - DNA, 18 bp, synthetic construct
  source 1..18: mol_type = other DNA
taatccatcttactctgg

SEQ ID NO: 70180 - DNA, 18 bp, synthetic construct
  source 1..18: mol_type = other DNA
taatccgaaacgcaatag

SEQ ID NO: 70181 - DNA, 18 bp, synthetic construct
  source 1..18: mol_type = other DNA
taatccgacaatcaatag

SEQ ID NO: 70182 - DNA, 18 bp, synthetic construct
  source 1..18: mol_type = other DNA
taatccgacccccattag

SEQ ID NO: 70183 - DNA, 18 bp, synthetic construct
  source 1..18: mol_type = other DNA
taatccgattatctattg

SEQ ID NO: 70184 - DNA, 18 bp, synthetic construct
  source 1..18: mol_type = other DNA
taatcctacactcttttg

SEQ ID NO: 70185 - DNA, 18 bp, synthetic construct
  source 1..18: mol_type = other DNA
taatcctccccactttag

SEQ ID NO: 70186 - DNA, 18 bp, synthetic construct
  source 1..18: mol_type = other DNA
taatcggattcacttttg

SEQ ID NO: 70187 - DNA, 18 bp, synthetic construct
  source 1..18: mol_type = other DNA
taatcggtctttctaaag

SEQ ID NO: 70188 - DNA, 18 bp, synthetic construct
  source 1..18: mol_type = other DNA
taatgaggcacgccatag

SEQ ID NO: 70189 - DNA, 18 bp, synthetic construct
  source 1..18: mol_type = other DNA
taatgcatgacattatag

SEQ ID NO: 70190 - DNA, 18 bp, synthetic construct
  source 1..18: mol_type = other DNA
taatgcgacacagtactg

SEQ ID NO: 70191 - DNA, 18 bp, synthetic construct
  source 1..18: mol_type = other DNA
taatgcgattcacataag

SEQ ID NO: 70192 - DNA, 18 bp, synthetic construct
  source 1..18: mol_type = other DNA
taatgcgatttataactg

SEQ ID NO: 70193 - DNA, 18 bp, synthetic construct
  source 1..18: mol_type = other DNA
taatgtaacttaataatg

SEQ ID NO: 70194 - DNA, 18 bp, synthetic construct
  source 1..18: mol_type = other DNA
taattaaactctctttag

SEQ ID NO: 70195 - DNA, 18 bp, synthetic construct
  source 1..18: mol_type = other DNA
taattagacccactaatg

SEQ ID NO: 70196 - DNA, 18 bp, synthetic construct
  source 1..18: mol_type = other DNA
taattagactctctactg

SEQ ID NO: 70197 - DNA, 18 bp, synthetic construct
  source 1..18: mol_type = other DNA
taattagtctcatttttg

SEQ ID NO: 70198 - DNA, 18 bp, synthetic construct
  source 1..18: mol_type = other DNA
taattcacctcacgtgtg

SEQ ID NO: 70199 - DNA, 18 bp, synthetic construct
  source 1..18: mol_type = other DNA
taattcagctttctattg

SEQ ID NO: 70200 - DNA, 18 bp, synthetic construct
  source 1..18: mol_type = other DNA
taattcgaatctcttaag

SEQ ID NO: 70201 - DNA, 18 bp, synthetic construct
  source 1..18: mol_type = other DNA
taattcgacaatcaatag

SEQ ID NO: 70202 - DNA, 18 bp, synthetic construct
  source 1..18: mol_type = other DNA
taattcgacaatccatag

SEQ ID NO: 70203 - DNA, 18 bp, synthetic construct
  source 1..18: mol_type = other DNA
taattcgacactatattg

SEQ ID NO: 70204 - DNA, 18 bp, synthetic construct
  source 1..18: mol_type = other DNA
taattcgacatacgaaag

SEQ ID NO: 70205 - DNA, 18 bp, synthetic construct
  source 1..18: mol_type = other DNA
taattcgacatactaatg

SEQ ID NO: 70206 - DNA, 18 bp, synthetic construct
  source 1..18: mol_type = other DNA
taattcgactcgctcatg

SEQ ID NO: 70207 - DNA, 18 bp, synthetic construct
  source 1..18: mol_type = other DNA
taattcgactcttaaaag

SEQ ID NO: 70208 - DNA, 18 bp, synthetic construct
  source 1..18: mol_type = other DNA
taattcgaggcactaatg

SEQ ID NO: 70209 - DNA, 18 bp, synthetic construct
  source 1..18: mol_type = other DNA
taattcgattctgtttcg

SEQ ID NO: 70210 - DNA, 18 bp, synthetic construct
  source 1..18: mol_type = other DNA
taattcgcttctcaatag

SEQ ID NO: 70211 - DNA, 18 bp, synthetic construct
  source 1..18: mol_type = other DNA
taattcgtatgactattg

SEQ ID NO: 70212 - DNA, 18 bp, synthetic construct
  source 1..18: mol_type = other DNA
taattcgtcactccgaag

SEQ ID NO: 70213 - DNA, 18 bp, synthetic construct
  source 1..18: mol_type = other DNA
taattcgtctcacattcg

SEQ ID NO: 70214 - DNA, 18 bp, synthetic construct
  source 1..18: mol_type = other DNA
taattctaacaactatag

SEQ ID NO: 70215 - DNA, 18 bp, synthetic construct
  source 1..18: mol_type = other DNA
taattctaatcactagcg

SEQ ID NO: 70216 - DNA, 18 bp, synthetic construct
  source 1..18: mol_type = other DNA
taattctacataatatag

SEQ ID NO: 70217 - DNA, 18 bp, synthetic construct
  source 1..18: mol_type = other DNA
taattctactaagtattg

SEQ ID NO: 70218 - DNA, 18 bp, synthetic construct
  source 1..18: mol_type = other DNA
taattctactagctattg

SEQ ID NO: 70219 - DNA, 18 bp, synthetic construct
  source 1..18: mol_type = other DNA
taattctactcgataaag

SEQ ID NO: 70220 - DNA, 18 bp, synthetic construct
  source 1..18: mol_type = other DNA
taattctactttcattag

SEQ ID NO: 70221 - DNA, 18 bp, synthetic construct
  source 1..18: mol_type = other DNA
taattctcctcacaatcg

SEQ ID NO: 70222 - DNA, 18 bp, synthetic construct
  source 1..18: mol_type = other DNA
taattgtactttcttttg

SEQ ID NO: 70223 - DNA, 18 bp, synthetic construct
  source 1..18: mol_type = other DNA
taatttctctcattattg

SEQ ID NO: 70224 - DNA, 18 bp, synthetic construct
  source 1..18: mol_type = other DNA
taatttgaatctccatag

SEQ ID NO: 70225 - DNA, 18 bp, synthetic construct
  source 1..18: mol_type = other DNA
taatttgactacctaaag

SEQ ID NO: 70226 - DNA, 18 bp, synthetic construct
  source 1..18: mol_type = other DNA
taattttccttacaatag

SEQ ID NO: 70227 - DNA, 18 bp, synthetic construct
  source 1..18: mol_type = other DNA
tacaacgtctaactcttg

SEQ ID NO: 70228 - DNA, 18 bp, synthetic construct
  source 1..18: mol_type = other DNA
tactaagtttcagtttag

SEQ ID NO: 70229 - DNA, 18 bp, synthetic construct
  source 1..18: mol_type = other DNA
tactaatattcactattg

SEQ ID NO: 70230 - DNA, 18 bp, synthetic construct
  source 1..18: mol_type = other DNA
tactacccgtcaccatag

SEQ ID NO: 70231 - DNA, 18 bp, synthetic construct
  source 1..18: mol_type = other DNA
tactacgaaactctacag

SEQ ID NO: 70232 - DNA, 18 bp, synthetic construct
  source 1..18: mol_type = other DNA
tactacgacattatactg

SEQ ID NO: 70233 - DNA, 18 bp, synthetic construct
  source 1..18: mol_type = other DNA
tactacgactcacatatg

SEQ ID NO: 70234 - DNA, 18 bp, synthetic construct
  source 1..18: mol_type = other DNA
tactacgattcaataatg

SEQ ID NO: 70235 - DNA, 18 bp, synthetic construct
  source 1..18: mol_type = other DNA
tactacggcgctttatag

SEQ ID NO: 70236 - DNA, 18 bp, synthetic construct
  source 1..18: mol_type = other DNA
tactactactatctagag

SEQ ID NO: 70237 - DNA, 18 bp, synthetic construct
  source 1..18: mol_type = other DNA
tactactactcgctcacg

SEQ ID NO: 70238 - DNA, 18 bp, synthetic construct
  source 1..18: mol_type = other DNA
tactacttctcaatttag

SEQ ID NO: 70239 - DNA, 18 bp, synthetic construct
  source 1..18: mol_type = other DNA
tactatgtctcaccaaag

SEQ ID NO: 70240 - DNA, 18 bp, synthetic construct
  source 1..18: mol_type = other DNA
tactccgtttcgctacgg

SEQ ID NO: 70241 - DNA, 18 bp, synthetic construct
  source 1..18: mol_type = other DNA
tacttcgaaacactttag

SEQ ID NO: 70242 - DNA, 18 bp, synthetic construct
  source 1..18: mol_type = other DNA
tacttcgtttcccttaag

SEQ ID NO: 70243 - DNA, 18 bp, synthetic construct
  source 1..18: mol_type = other DNA
tagaacgattctcttaag

SEQ ID NO: 70244 - DNA, 18 bp, synthetic construct
  source 1..18: mol_type = other DNA
tagaacgtcgcactaatg

SEQ ID NO: 70245 - DNA, 18 bp, synthetic construct
  source 1..18: mol_type = other DNA
tagaacgtctcaatatgg

SEQ ID NO: 70246 - DNA, 18 bp, synthetic construct
  source 1..18: mol_type = other DNA
tagaacgtcttacagtag

SEQ ID NO: 70247 - DNA, 18 bp, synthetic construct
  source 1..18: mol_type = other DNA
tagaactacatactctag

SEQ ID NO: 70248 - DNA, 18 bp, synthetic construct
  source 1..18: mol_type = other DNA
tagaatgattctcttcag

SEQ ID NO: 70249 - DNA, 18 bp, synthetic construct
  source 1..18: mol_type = other DNA
tagaatgcctctctatag

SEQ ID NO: 70250 - DNA, 18 bp, synthetic construct
  source 1..18: mol_type = other DNA
tagactaactcactattg

SEQ ID NO: 70251 - DNA, 18 bp, synthetic construct
  source 1..18: mol_type = other DNA
tagatctactggctaatg

SEQ ID NO: 70252 - DNA, 18 bp, synthetic construct
  source 1..18: mol_type = other DNA
tagcactaaacacttcag

SEQ ID NO: 70253 - DNA, 18 bp, synthetic construct
  source 1..18: mol_type = other DNA
tagcatgactcagtagtg

SEQ ID NO: 70254 - DNA, 18 bp, synthetic construct
  source 1..18: mol_type = other DNA
tagtaagagcctcaattg

SEQ ID NO: 70255 - DNA, 18 bp, synthetic construct
  source 1..18: mol_type = other DNA
tagtaagtctctttaaag

SEQ ID NO: 70256 - DNA, 18 bp, synthetic construct
  source 1..18: mol_type = other DNA
tagtaatccacactatag

SEQ ID NO: 70257 - DNA, 18 bp, synthetic construct
  source 1..18: mol_type = other DNA
tagtacatcctattagag

SEQ ID NO: 70258 - DNA, 18 bp, synthetic construct
  source 1..18: mol_type = other DNA
tagtacgactaagaaacg

SEQ ID NO: 70259 - DNA, 18 bp, synthetic construct
  source 1..18: mol_type = other DNA
tagtacgtttcacgattg

SEQ ID NO: 70260 - DNA, 18 bp, synthetic construct
  source 1..18: mol_type = other DNA
tagtactacactctaaag

SEQ ID NO: 70261 - DNA, 18 bp, synthetic construct
  source 1..18: mol_type = other DNA
tagtactacctacaatag

SEQ ID NO: 70262 - DNA, 18 bp, synthetic construct
  source 1..18: mol_type = other DNA
tagtacttctctatatag

SEQ ID NO: 70263 - DNA, 18 bp, synthetic construct
  source 1..18: mol_type = other DNA
tagtatgactagcaactg

SEQ ID NO: 70264 - DNA, 18 bp, synthetic construct
  source 1..18: mol_type = other DNA
tagtccgaaacactattg

SEQ ID NO: 70265 - DNA, 18 bp, synthetic construct
  source 1..18: mol_type = other DNA
tagtccgcctcaatacag

SEQ ID NO: 70266 - DNA, 18 bp, synthetic construct
  source 1..18: mol_type = other DNA
tagtcctacactttattg

SEQ ID NO: 70267 - DNA, 18 bp, synthetic construct
  source 1..18: mol_type = other DNA
tagtctaactcagatttg

SEQ ID NO: 70268 - DNA, 18 bp, synthetic construct
  source 1..18: mol_type = other DNA
tagtgcgactcactcccg

SEQ ID NO: 70269 - DNA, 18 bp, synthetic construct
  source 1..18: mol_type = other DNA
tagtgcgacttactactg

SEQ ID NO: 70270 - DNA, 18 bp, synthetic construct
  source 1..18: mol_type = other DNA
tagttagactcacaattg

SEQ ID NO: 70271 - DNA, 18 bp, synthetic construct
  source 1..18: mol_type = other DNA
tagttcaactcactaatg

SEQ ID NO: 70272 - DNA, 18 bp, synthetic construct
  source 1..18: mol_type = other DNA
tagtttaatttactatag

SEQ ID NO: 70273 - DNA, 18 bp, synthetic construct
  source 1..18: mol_type = other DNA
tataaagactcaataaag

SEQ ID NO: 70274 - DNA, 18 bp, synthetic construct
  source 1..18: mol_type = other DNA
tataaagatttactatag

SEQ ID NO: 70275 - DNA, 18 bp, synthetic construct
  source 1..18: mol_type = other DNA
tataacgactgactgttg

SEQ ID NO: 70276 - DNA, 18 bp, synthetic construct
  source 1..18: mol_type = other DNA
tataacgacttactgaag

SEQ ID NO: 70277 - DNA, 18 bp, synthetic construct
  source 1..18: mol_type = other DNA
tataacggcgcactacag

SEQ ID NO: 70278 - DNA, 18 bp, synthetic construct
  source 1..18: mol_type = other DNA
tataacgtcacactattg

SEQ ID NO: 70279 - DNA, 18 bp, synthetic construct
  source 1..18: mol_type = other DNA
tataacgtctagctttag

SEQ ID NO: 70280 - DNA, 18 bp, synthetic construct
  source 1..18: mol_type = other DNA
tataacgtctcaatattg

SEQ ID NO: 70281 - DNA, 18 bp, synthetic construct
  source 1..18: mol_type = other DNA
tataacgtctcattaaag

SEQ ID NO: 70282 - DNA, 18 bp, synthetic construct
  source 1..18: mol_type = other DNA
tataatgactgtctatag

SEQ ID NO: 70283 - DNA, 18 bp, synthetic construct
  source 1..18: mol_type = other DNA
tataccgactctatattg

SEQ ID NO: 70284 - DNA, 18 bp, synthetic construct
  source 1..18: mol_type = other DNA
tataccgtgtcagtatag

SEQ ID NO: 70285 - DNA, 18 bp, synthetic construct
  source 1..18: mol_type = other DNA
tatatcgacagacaatag

SEQ ID NO: 70286 - DNA, 18 bp, synthetic construct
  source 1..18: mol_type = other DNA
tatatttgcacactatag

SEQ ID NO: 70287 - DNA, 18 bp, synthetic construct
  source 1..18: mol_type = other DNA
tatcaagactctctttag

SEQ ID NO: 70288 - DNA, 18 bp, synthetic construct
  source 1..18: mol_type = other DNA
tatcacgactctcaaaag

SEQ ID NO: 70289 - DNA, 18 bp, synthetic construct
  source 1..18: mol_type = other DNA
tatcacgtctcttttaag

SEQ ID NO: 70290 - DNA, 18 bp, synthetic construct
  source 1..18: mol_type = other DNA
tatcccgactcaatattg

SEQ ID NO: 70291 - DNA, 18 bp, synthetic construct
  source 1..18: mol_type = other DNA
tatctagtctcactatag

SEQ ID NO: 70292 - DNA, 18 bp, synthetic construct
  source 1..18: mol_type = other DNA
tatgacaacactctatag

SEQ ID NO: 70293 - DNA, 18 bp, synthetic construct
  source 1..18: mol_type = other DNA
tatgtgtcgttactgtag

SEQ ID NO: 70294 - DNA, 18 bp, synthetic construct
  source 1..18: mol_type = other DNA
tattaagactcattccag

SEQ ID NO: 70295 - DNA, 18 bp, synthetic construct
  source 1..18: mol_type = other DNA
tattaagtcacactattg

SEQ ID NO: 70296 - DNA, 18 bp, synthetic construct
  source 1..18: mol_type = other DNA
tattaagtctaactattg

SEQ ID NO: 70297 - DNA, 18 bp, synthetic construct
  source 1..18: mol_type = other DNA
tattacaactcaaaaccg

SEQ ID NO: 70298 - DNA, 18 bp, synthetic construct
  source 1..18: mol_type = other DNA
tattaccactcgttattg

SEQ ID NO: 70299 - DNA, 18 bp, synthetic construct
  source 1..18: mol_type = other DNA
tattacgaacctttattg

SEQ ID NO: 70300 - DNA, 18 bp, synthetic construct
  source 1..18: mol_type = other DNA
tattacgaatgacttaag

SEQ ID NO: 70301 - DNA, 18 bp, synthetic construct
  source 1..18: mol_type = other DNA
tattacgactatcttttg

SEQ ID NO: 70302 - DNA, 18 bp, synthetic construct
  source 1..18: mol_type = other DNA
tattacgactccccgaag

SEQ ID NO: 70303 - DNA, 18 bp, synthetic construct
  source 1..18: mol_type = other DNA
tattacgagtatcttcag

SEQ ID NO: 70304 - DNA, 18 bp, synthetic construct
  source 1..18: mol_type = other DNA
tattacgatacattttag

SEQ ID NO: 70305 - DNA, 18 bp, synthetic construct
  source 1..18: mol_type = other DNA
tattacgattcaattaag

SEQ ID NO: 70306 - DNA, 18 bp, synthetic construct
  source 1..18: mol_type = other DNA
tattacgcgtcatgaaag

SEQ ID NO: 70307 - DNA, 18 bp, synthetic construct
  source 1..18: mol_type = other DNA
tattacggctaagtattg

SEQ ID NO: 70308 - DNA, 18 bp, synthetic construct
  source 1..18: mol_type = other DNA
tattacgtatttcaaaag

SEQ ID NO: 70309 - DNA, 18 bp, synthetic construct
  source 1..18: mol_type = other DNA
tattacgtctgattaagg

SEQ ID NO: 70310 - DNA, 18 bp, synthetic construct
  source 1..18: mol_type = other DNA
tattacgtttcacttttg

SEQ ID NO: 70311 - DNA, 18 bp, synthetic construct
  source 1..18: mol_type = other DNA
tattactacactcttaag

SEQ ID NO: 70312 - DNA, 18 bp, synthetic construct
  source 1..18: mol_type = other DNA
tattactattccatatag

SEQ ID NO: 70313 - DNA, 18 bp, synthetic construct
  source 1..18: mol_type = other DNA
tattacttcattatctag

SEQ ID NO: 70314 - DNA, 18 bp, synthetic construct
  source 1..18: mol_type = other DNA
tattacttctagctatag

SEQ ID NO: 70315 - DNA, 18 bp, synthetic construct
  source 1..18: mol_type = other DNA
tattagtaatcaatatag

SEQ ID NO: 70316 - DNA, 18 bp, synthetic construct
  source 1..18: mol_type = other DNA
tattatagcacacttatg

SEQ ID NO: 70317 - DNA, 18 bp, synthetic construct
  source 1..18: mol_type = other DNA
tattatgactgcctacag

SEQ ID NO: 70318 - DNA, 18 bp, synthetic construct
  source 1..18: mol_type = other DNA
tattatgacttactaatg

SEQ ID NO: 70319 - DNA, 18 bp, synthetic construct
  source 1..18: mol_type = other DNA
tattatgatattccacag

SEQ ID NO: 70320 - DNA, 18 bp, synthetic construct
  source 1..18: mol_type = other DNA
tattatgtcaaactatag

SEQ ID NO: 70321 - DNA, 18 bp, synthetic construct
  source 1..18: mol_type = other DNA
tattcagactcacgatcg

SEQ ID NO: 70322 - DNA, 18 bp, synthetic construct
  source 1..18: mol_type = other DNA
tattccgactatttatag

SEQ ID NO: 70323 - DNA, 18 bp, synthetic construct
  source 1..18: mol_type = other DNA
tattgcgacccaatattg

SEQ ID NO: 70324 - DNA, 18 bp, synthetic construct
  source 1..18: mol_type = other DNA
tattgtgactctcaatag

SEQ ID NO: 70325 - DNA, 18 bp, synthetic construct
  source 1..18: mol_type = other DNA
tatttcaacacattatag

SEQ ID NO: 70326 - DNA, 18 bp, synthetic construct
  source 1..18: mol_type = other DNA
tatttcaactcacaatcg

SEQ ID NO: 70327 - DNA, 18 bp, synthetic construct
  source 1..18: mol_type = other DNA
tatttcgaatcgctatcg

SEQ ID NO: 70328 - DNA, 18 bp, synthetic construct
  source 1..18: mol_type = other DNA
tatttcgacaatctatag

SEQ ID NO: 70329 - DNA, 18 bp, synthetic construct
  source 1..18: mol_type = other DNA
tatttcgacttacaaaag

SEQ ID NO: 70330 - DNA, 18 bp, synthetic construct
  source 1..18: mol_type = other DNA
tatttcgattcaacaaag

SEQ ID NO: 70331 - DNA, 18 bp, synthetic construct
  source 1..18: mol_type = other DNA
tatttcgattcacaaaag

SEQ ID NO: 70332 - DNA, 18 bp, synthetic construct
  source 1..18: mol_type = other DNA
tatttcgtctctgtatag

SEQ ID NO: 70333 - DNA, 18 bp, synthetic construct
  source 1..18: mol_type = other DNA
tatttctactcaccttag

SEQ ID NO: 70334 - DNA, 18 bp, synthetic construct
  source 1..18: mol_type = other DNA
tatttctacttactgtag

SEQ ID NO: 70335 - DNA, 18 bp, synthetic construct
  source 1..18: mol_type = other DNA
tatttgtacacactaatg

SEQ ID NO: 70336 - DNA, 18 bp, synthetic construct
  source 1..18: mol_type = other DNA
tcaaaagacttcctatag

SEQ ID NO: 70337 - DNA, 18 bp, synthetic construct
  source 1..18: mol_type = other DNA
tcaaacgaatcactagcg

SEQ ID NO: 70338 - DNA, 18 bp, synthetic construct
  source 1..18: mol_type = other DNA
tcaatcgacacactaaag

SEQ ID NO: 70339 - DNA, 18 bp, synthetic construct
  source 1..18: mol_type = other DNA
tcacacgacttatgagag

SEQ ID NO: 70340 - DNA, 18 bp, synthetic construct
  source 1..18: mol_type = other DNA
tcacactagtaattatag

SEQ ID NO: 70341 - DNA, 18 bp, synthetic construct
  source 1..18: mol_type = other DNA
tcataccactcaatgttg

SEQ ID NO: 70342 - DNA, 18 bp, synthetic construct
  source 1..18: mol_type = other DNA
tcataccacttatcaacg

SEQ ID NO: 70343 - DNA, 18 bp, synthetic construct
  source 1..18: mol_type = other DNA
tcatacctcacactaaag

SEQ ID NO: 70344 - DNA, 18 bp, synthetic construct
  source 1..18: mol_type = other DNA
tcatacgatacttaattg

SEQ ID NO: 70345 - DNA, 18 bp, synthetic construct
  source 1..18: mol_type = other DNA
tcatacgcctcaggatcg

SEQ ID NO: 70346 - DNA, 18 bp, synthetic construct
  source 1..18: mol_type = other DNA
tcatacggccctccatag

SEQ ID NO: 70347 - DNA, 18 bp, synthetic construct
  source 1..18: mol_type = other DNA
tcatacgtcacagaatag

SEQ ID NO: 70348 - DNA, 18 bp, synthetic construct
  source 1..18: mol_type = other DNA
tcatacgtcacattggag

SEQ ID NO: 70349 - DNA, 18 bp, synthetic construct
  source 1..18: mol_type = other DNA
tcatagcattcagtatag

SEQ ID NO: 70350 - DNA, 18 bp, synthetic construct
  source 1..18: mol_type = other DNA
tcatagccttaactatag

SEQ ID NO: 70351 - DNA, 18 bp, synthetic construct
  source 1..18: mol_type = other DNA
tcatagtacacgctatag

SEQ ID NO: 70352 - DNA, 18 bp, synthetic construct
  source 1..18: mol_type = other DNA
tcatcagtatccctttag

SEQ ID NO: 70353 - DNA, 18 bp, synthetic construct
  source 1..18: mol_type = other DNA
tcatctaactcacactag

SEQ ID NO: 70354 - DNA, 18 bp, synthetic construct
  source 1..18: mol_type = other DNA
tcatgccactaatcatag

SEQ ID NO: 70355 - DNA, 18 bp, synthetic construct
  source 1..18: mol_type = other DNA
tcatgcggtgctcaatgg

SEQ ID NO: 70356 - DNA, 18 bp, synthetic construct
  source 1..18: mol_type = other DNA
tcatgcgtctcactttcg

SEQ ID NO: 70357 - DNA, 18 bp, synthetic construct
  source 1..18: mol_type = other DNA
tcatgcgtctttctatag

SEQ ID NO: 70358 - DNA, 18 bp, synthetic construct
  source 1..18: mol_type = other DNA
tcattagactcattattg

SEQ ID NO: 70359 - DNA, 18 bp, synthetic construct
  source 1..18: mol_type = other DNA
tcattccactctcgattg

SEQ ID NO: 70360 - DNA, 18 bp, synthetic construct
  source 1..18: mol_type = other DNA
tcattcgaattactctag

SEQ ID NO: 70361 - DNA, 18 bp, synthetic construct
  source 1..18: mol_type = other DNA
tcattcgactcacttctg

SEQ ID NO: 70362 - DNA, 18 bp, synthetic construct
  source 1..18: mol_type = other DNA
tcattctaataatcatag

SEQ ID NO: 70363 - DNA, 18 bp, synthetic construct
  source 1..18: mol_type = other DNA
tccttcgaatctccattg

SEQ ID NO: 70364 - DNA, 18 bp, synthetic construct
  source 1..18: mol_type = other DNA
tcgtattactctcaatag

SEQ ID NO: 70365 - DNA, 18 bp, synthetic construct
  source 1..18: mol_type = other DNA
tcgttcgactcactaaaa

SEQ ID NO: 70366 - DNA, 18 bp, synthetic construct
  source 1..18: mol_type = other DNA
tctaacgactgtttaaag

SEQ ID NO: 70367 - DNA, 18 bp, synthetic construct
  source 1..18: mol_type = other DNA
tcttacgtccaacaatag

SEQ ID NO: 70368 - DNA, 18 bp, synthetic construct
  source 1..18: mol_type = other DNA
tcttactcatcacttacg

SEQ ID NO: 70369 - DNA, 18 bp, synthetic construct
  source 1..18: mol_type = other DNA
tcttaggccttactatag

SEQ ID NO: 70370 - DNA, 18 bp, synthetic construct
  source 1..18: mol_type = other DNA
tctttagtctcactatag

SEQ ID NO: 70371 - DNA, 18 bp, synthetic construct
  source 1..18: mol_type = other DNA
tctttcaactcattatag

SEQ ID NO: 70372 - DNA, 18 bp, synthetic construct
  source 1..18: mol_type = other DNA
tctttcgtctcactttag

SEQ ID NO: 70373 - DNA, 18 bp, synthetic construct
  source 1..18: mol_type = other DNA
tgaagcgagtcgccatag

SEQ ID NO: 70374 - DNA, 18 bp, synthetic construct
  source 1..18: mol_type = other DNA
tgacaccactaactattg

SEQ ID NO: 70375 - DNA, 18 bp, synthetic construct
  source 1..18: mol_type = other DNA
tgagacaactcaacatag

SEQ ID NO: 70376 - DNA, 18 bp, synthetic construct
  source 1..18: mol_type = other DNA
tgatacgatacgctaaag

SEQ ID NO: 70377 - DNA, 18 bp, synthetic construct
  source 1..18: mol_type = other DNA
tgatactagtcaccaaag

SEQ ID NO: 70378 - DNA, 18 bp, synthetic construct
  source 1..18: mol_type = other DNA
tgatactccacacttcag

SEQ ID NO: 70379 - DNA, 18 bp, synthetic construct
  source 1..18: mol_type = other DNA
tgataggagtctctgtgg

SEQ ID NO: 70380 - DNA, 18 bp, synthetic construct
  source 1..18: mol_type = other DNA
tgatatgaatgagtctag

SEQ ID NO: 70381 - DNA, 18 bp, synthetic construct
  source 1..18: mol_type = other DNA
tgatgagaatctctatag

SEQ ID NO: 70382 - DNA, 18 bp, synthetic construct
  source 1..18: mol_type = other DNA
tgatggaacacacttcag

SEQ ID NO: 70383 - DNA, 18 bp, synthetic construct
  source 1..18: mol_type = other DNA
tgattcaactctccaaag

SEQ ID NO: 70384 - DNA, 18 bp, synthetic construct
  source 1..18: mol_type = other DNA
tgattcgactcacataag

SEQ ID NO: 70385 - DNA, 18 bp, synthetic construct
  source 1..18: mol_type = other DNA
tgctacgattaaccatag

SEQ ID NO: 70386 - DNA, 18 bp, synthetic construct
  source 1..18: mol_type = other DNA
tgctacgtatcactaaag

SEQ ID NO: 70387 - DNA, 18 bp, synthetic construct
  source 1..18: mol_type = other DNA
tgctattacacactatag

SEQ ID NO: 70388 - DNA, 18 bp, synthetic construct
  source 1..18: mol_type = other DNA
tgctctgaataattagag

SEQ ID NO: 70389 - DNA, 18 bp, synthetic construct
  source 1..18: mol_type = other DNA
tggtacgacataggatag

SEQ ID NO: 70390 - DNA, 18 bp, synthetic construct
  source 1..18: mol_type = other DNA
tggtggatgatactaaag

SEQ ID NO: 70391 - DNA, 18 bp, synthetic construct
  source 1..18: mol_type = other DNA
tgttaacactcacaattg

SEQ ID NO: 70392 - DNA, 18 bp, synthetic construct
  source 1..18: mol_type = other DNA
tgttaagaaaccctatag

SEQ ID NO: 70393 - DNA, 18 bp, synthetic construct
  source 1..18: mol_type = other DNA
tgttaagacacactttag

SEQ ID NO: 70394 - DNA, 18 bp, synthetic construct
  source 1..18: mol_type = other DNA
tgttacgaatctcaatag

SEQ ID NO: 70395 - DNA, 18 bp, synthetic construct
  source 1..18: mol_type = other DNA
tgttacgacacattttag

SEQ ID NO: 70396 - DNA, 18 bp, synthetic construct
  source 1..18: mol_type = other DNA
tgttatgactctctcttg

SEQ ID NO: 70397 - DNA, 18 bp, synthetic construct
  source 1..18: mol_type = other DNA
tgtttagattcactatag

SEQ ID NO: 70398 - DNA, 18 bp, synthetic construct
  source 1..18: mol_type = other DNA
tgtttcgactaactaaag

SEQ ID NO: 70399 - DNA, 18 bp, synthetic construct
  source 1..18: mol_type = other DNA
tgtttcgactcatcttag

SEQ ID NO: 70400 - DNA, 18 bp, synthetic construct
  source 1..18: mol_type = other DNA
tgtttcgtctcattatag

SEQ ID NO: 70401 - DNA, 18 bp, synthetic construct
  source 1..18: mol_type = other DNA
tgtttctactcacaacag

SEQ ID NO: 70402 - DNA, 18 bp, synthetic construct
  source 1..18: mol_type = other DNA
ttaaaagaaacaccatag

SEQ ID NO: 70403 - DNA, 18 bp, synthetic construct
  source 1..18: mol_type = other DNA
ttaaaccacttatttttg

SEQ ID NO: 70404 - DNA, 18 bp, synthetic construct
  source 1..18: mol_type = other DNA
ttaaacgaaacacttttg

SEQ ID NO: 70405 - DNA, 18 bp, synthetic construct
  source 1..18: mol_type = other DNA
ttaaacgactcacaactg

SEQ ID NO: 70406 - DNA, 18 bp, synthetic construct
  source 1..18: mol_type = other DNA
ttaaacgacttatctctg

SEQ ID NO: 70407 - DNA, 18 bp, synthetic construct
  source 1..18: mol_type = other DNA
ttaaacgacttgccatag

SEQ ID NO: 70408 - DNA, 18 bp, synthetic construct
  source 1..18: mol_type = other DNA
ttaaacgtcactttaatg

SEQ ID NO: 70409 - DNA, 18 bp, synthetic construct
  source 1..18: mol_type = other DNA
ttaaacgtctaattatag

SEQ ID NO: 70410 - DNA, 18 bp, synthetic construct
  source 1..18: mol_type = other DNA
ttaaactgatcactattg

SEQ ID NO: 70411 - DNA, 18 bp, synthetic construct
  source 1..18: mol_type = other DNA
ttaaacttttcactatag

SEQ ID NO: 70412 - DNA, 18 bp, synthetic construct
  source 1..18: mol_type = other DNA
ttaatcgtctcactgtag

SEQ ID NO: 70413 - DNA, 18 bp, synthetic construct
  source 1..18: mol_type = other DNA
ttacacaactcacaagag

SEQ ID NO: 70414 - DNA, 18 bp, synthetic construct
  source 1..18: mol_type = other DNA
ttacacatcttactctag

SEQ ID NO: 70415 - DNA, 18 bp, synthetic construct
  source 1..18: mol_type = other DNA
ttacacgacattttattg

SEQ ID NO: 70416 - DNA, 18 bp, synthetic construct
  source 1..18: mol_type = other DNA
ttactcaacacacaaccg

SEQ ID NO: 70417 - DNA, 18 bp, synthetic construct
  source 1..18: mol_type = other DNA
ttactcgacacactctgg

SEQ ID NO: 70418 - DNA, 18 bp, synthetic construct
  source 1..18: mol_type = other DNA
ttactcgactcaccacag

SEQ ID NO: 70419 - DNA, 18 bp, synthetic construct
  source 1..18: mol_type = other DNA
ttagacgaatcactcatg

SEQ ID NO: 70420 - DNA, 18 bp, synthetic construct
  source 1..18: mol_type = other DNA
ttaggcgactcataattg

SEQ ID NO: 70421 - DNA, 18 bp, synthetic construct
  source 1..18: mol_type = other DNA
ttataactcttactattg

SEQ ID NO: 70422 - DNA, 18 bp, synthetic construct
  source 1..18: mol_type = other DNA
ttataagtctttgcaaag

SEQ ID NO: 70423 - DNA, 18 bp, synthetic construct
  source 1..18: mol_type = other DNA
ttatacaacatacaatag

SEQ ID NO: 70424 - DNA, 18 bp, synthetic construct
  source 1..18: mol_type = other DNA
ttatacatctcacaattg

SEQ ID NO: 70425 - DNA, 18 bp, synthetic construct
  source 1..18: mol_type = other DNA
ttataccgttcactacag

SEQ ID NO: 70426 - DNA, 18 bp, synthetic construct
  source 1..18: mol_type = other DNA
ttatacgaaacactaatg

SEQ ID NO: 70427 - DNA, 18 bp, synthetic construct
  source 1..18: mol_type = other DNA
ttatacgaattcctttag

SEQ ID NO: 70428 - DNA, 18 bp, synthetic construct
  source 1..18: mol_type = other DNA
ttatacgacaaattaaag

SEQ ID NO: 70429 - DNA, 18 bp, synthetic construct
  source 1..18: mol_type = other DNA
ttatacgactacctaatg

SEQ ID NO: 70430 - DNA, 18 bp, synthetic construct
  source 1..18: mol_type = other DNA
ttatacgactccacttag

SEQ ID NO: 70431 - DNA, 18 bp, synthetic construct
  source 1..18: mol_type = other DNA
ttatacgactccattcag

SEQ ID NO: 70432 - DNA, 18 bp, synthetic construct
  source 1..18: mol_type = other DNA
ttatacgactctctcacg

SEQ ID NO: 70433 - DNA, 18 bp, synthetic construct
  source 1..18: mol_type = other DNA
ttatacgacttaatttcg

SEQ ID NO: 70434 - DNA, 18 bp, synthetic construct
  source 1..18: mol_type = other DNA
ttatacgacttccttaag

SEQ ID NO: 70435 - DNA, 18 bp, synthetic construct
  source 1..18: mol_type = other DNA
ttatacgacttgatttag

SEQ ID NO: 70436 - DNA, 18 bp, synthetic construct
  source 1..18: mol_type = other DNA
ttatacgagtctgcaaag

SEQ ID NO: 70437 - DNA, 18 bp, synthetic construct
  source 1..18: mol_type = other DNA
ttatacgattctttacag

SEQ ID NO: 70438 - DNA, 18 bp, synthetic construct
  source 1..18: mol_type = other DNA
ttatacgcataactattg

SEQ ID NO: 70439 - DNA, 18 bp, synthetic construct
  source 1..18: mol_type = other DNA
ttatacgctttacaaaag

SEQ ID NO: 70440 - DNA, 18 bp, synthetic construct
  source 1..18: mol_type = other DNA
ttatacggctctatattg

SEQ ID NO: 70441 - DNA, 18 bp, synthetic construct
  source 1..18: mol_type = other DNA
ttatacggcttaccttag

SEQ ID NO: 70442 - DNA, 18 bp, synthetic construct
  source 1..18: mol_type = other DNA
ttatacggcttagttttg

SEQ ID NO: 70443 - DNA, 18 bp, synthetic construct
  source 1..18: mol_type = other DNA
ttatacggttctctagag

SEQ ID NO: 70444 - DNA, 18 bp, synthetic construct
  source 1..18: mol_type = other DNA
ttatacgtctatttatag

SEQ ID NO: 70445 - DNA, 18 bp, synthetic construct
  source 1..18: mol_type = other DNA
ttatacgtctcacataag

SEQ ID NO: 70446 - DNA, 18 bp, synthetic construct
  source 1..18: mol_type = other DNA
ttatacgtctcgacctgg

SEQ ID NO: 70447 - DNA, 18 bp, synthetic construct
  source 1..18: mol_type = other DNA
ttatacgtcttactggag

SEQ ID NO: 70448 - DNA, 18 bp, synthetic construct
  source 1..18: mol_type = other DNA
ttatacgtgtcattattg

SEQ ID NO: 70449 - DNA, 18 bp, synthetic construct
  source 1..18: mol_type = other DNA
ttatacgtttcagttaag

SEQ ID NO: 70450 - DNA, 18 bp, synthetic construct
  source 1..18: mol_type = other DNA
ttatactaatcacttcag

SEQ ID NO: 70451 - DNA, 18 bp, synthetic construct
  source 1..18: mol_type = other DNA
ttatactaattagtaaag

SEQ ID NO: 70452 - DNA, 18 bp, synthetic construct
  source 1..18: mol_type = other DNA
ttatactactctcaaatg

SEQ ID NO: 70453 - DNA, 18 bp, synthetic construct
  source 1..18: mol_type = other DNA
ttatactatccactattg

SEQ ID NO: 70454 - DNA, 18 bp, synthetic construct
  source 1..18: mol_type = other DNA
ttatacttatcactattg

SEQ ID NO: 70455 - DNA, 18 bp, synthetic construct
  source 1..18: mol_type = other DNA
ttatacttctcattagga

SEQ ID NO: 70456 - DNA, 18 bp, synthetic construct
  source 1..18: mol_type = other DNA
ttatatgacacactcccg

SEQ ID NO: 70457 - DNA, 18 bp, synthetic construct
  source 1..18: mol_type = other DNA
ttatatgagtcactactg

SEQ ID NO: 70458 - DNA, 18 bp, synthetic construct
  source 1..18: mol_type = other DNA
ttatatgattaacaatag

SEQ ID NO: 70459 - DNA, 18 bp, synthetic construct
  source 1..18: mol_type = other DNA
ttatatgatttactttag

SEQ ID NO: 70460 - DNA, 18 bp, synthetic construct
  source 1..18: mol_type = other DNA
ttatatgccccactattg

SEQ ID NO: 70461 - DNA, 18 bp, synthetic construct
  source 1..18: mol_type = other DNA
ttatattattccctatag

SEQ ID NO: 70462 - DNA, 18 bp, synthetic construct
  source 1..18: mol_type = other DNA
ttatcccactctatatag

SEQ ID NO: 70463 - DNA, 18 bp, synthetic construct
  source 1..18: mol_type = other DNA
ttatccgacgcactaatg

SEQ ID NO: 70464 - DNA, 18 bp, synthetic construct
  source 1..18: mol_type = other DNA
ttatgcaactcacaaaag

SEQ ID NO: 70465 - DNA, 18 bp, synthetic construct
  source 1..18: mol_type = other DNA
ttatgcctctctctaaag

SEQ ID NO: 70466 - DNA, 18 bp, synthetic construct
  source 1..18: mol_type = other DNA
ttatgggaatcgctaatg

SEQ ID NO: 70467 - DNA, 18 bp, synthetic construct
  source 1..18: mol_type = other DNA
ttattagagtcactattg

SEQ ID NO: 70468 - DNA, 18 bp, synthetic construct
  source 1..18: mol_type = other DNA
ttattcaattcactctag

SEQ ID NO: 70469 - DNA, 18 bp, synthetic construct
  source 1..18: mol_type = other DNA
ttattcatctcactaaag

SEQ ID NO: 70470 - DNA, 18 bp, synthetic construct
  source 1..18: mol_type = other DNA
ttattcgacacacaatgg

SEQ ID NO: 70471 - DNA, 18 bp, synthetic construct
  source 1..18: mol_type = other DNA
ttattcgacactctaaag

SEQ ID NO: 70472 - DNA, 18 bp, synthetic construct
  source 1..18: mol_type = other DNA
ttattcgactgtctatgg

SEQ ID NO: 70473 - DNA, 18 bp, synthetic construct
  source 1..18: mol_type = other DNA
ttattcgcctcacactag

SEQ ID NO: 70474 - DNA, 18 bp, synthetic construct
  source 1..18: mol_type = other DNA
ttattcgcttcactttag

SEQ ID NO: 70475 - DNA, 18 bp, synthetic construct
  source 1..18: mol_type = other DNA
ttattcgtatgactttag

SEQ ID NO: 70476 - DNA, 18 bp, synthetic construct
  source 1..18: mol_type = other DNA
ttattcgtctctctattg

SEQ ID NO: 70477 - DNA, 18 bp, synthetic construct
  source 1..18: mol_type = other DNA
ttattcgtctttctatag

SEQ ID NO: 70478 - DNA, 18 bp, synthetic construct
  source 1..18: mol_type = other DNA
ttattcgttccactatag

SEQ ID NO: 70479 - DNA, 18 bp, synthetic construct
  source 1..18: mol_type = other DNA
ttattctgtaaacaatag

SEQ ID NO: 70480 - DNA, 18 bp, synthetic construct
  source 1..18: mol_type = other DNA
ttatttaactcattattg

SEQ ID NO: 70481 - DNA, 18 bp, synthetic construct
  source 1..18: mol_type = other DNA
ttatttgactcattattg

SEQ ID NO: 70482 - DNA, 18 bp, synthetic construct
  source 1..18: mol_type = other DNA
ttatttgtctcactaaag

SEQ ID NO: 70483 - DNA, 18 bp, synthetic construct
  source 1..18: mol_type = other DNA
ttcaacgattcactttag

SEQ ID NO: 70484 - DNA, 18 bp, synthetic construct
  source 1..18: mol_type = other DNA
ttcaacgtctaactattg

SEQ ID NO: 70485 - DNA, 18 bp, synthetic construct
  source 1..18: mol_type = other DNA
ttcaacgttatacttaag

SEQ ID NO: 70486 - DNA, 18 bp, synthetic construct
  source 1..18: mol_type = other DNA
ttcaactactcattatag

SEQ ID NO: 70487 - DNA, 18 bp, synthetic construct
  source 1..18: mol_type = other DNA
ttcaccgacataatacag

SEQ ID NO: 70488 - DNA, 18 bp, synthetic construct
  source 1..18: mol_type = other DNA
ttcaccgacttacaattg

SEQ ID NO: 70489 - DNA, 18 bp, synthetic construct
  source 1..18: mol_type = other DNA
ttctacaacacactacag

SEQ ID NO: 70490 - DNA, 18 bp, synthetic construct
  source 1..18: mol_type = other DNA
ttctaccactaagtatag

SEQ ID NO: 70491 - DNA, 18 bp, synthetic construct
  source 1..18: mol_type = other DNA
ttctacgtccttgaatgg

SEQ ID NO: 70492 - DNA, 18 bp, synthetic construct
  source 1..18: mol_type = other DNA
ttctacgtcttgcagtag

SEQ ID NO: 70493 - DNA, 18 bp, synthetic construct
  source 1..18: mol_type = other DNA
ttctatgacccacaatag

SEQ ID NO: 70494 - DNA, 18 bp, synthetic construct
  source 1..18: mol_type = other DNA
ttctccttctcacaatag

SEQ ID NO: 70495 - DNA, 18 bp, synthetic construct
  source 1..18: mol_type = other DNA
ttgaacgactgtctatag

SEQ ID NO: 70496 - DNA, 18 bp, synthetic construct
  source 1..18: mol_type = other DNA
ttgatcgagtctctatag

SEQ ID NO: 70497 - DNA, 18 bp, synthetic construct
  source 1..18: mol_type = other DNA
ttggacggctcacattag

SEQ ID NO: 70498 - DNA, 18 bp, synthetic construct
  source 1..18: mol_type = other DNA
ttgtaagactgactaaag

SEQ ID NO: 70499 - DNA, 18 bp, synthetic construct
  source 1..18: mol_type = other DNA
ttgtacgactctttgtag

SEQ ID NO: 70500 - DNA, 18 bp, synthetic construct
  source 1..18: mol_type = other DNA
ttgtacgtctaacaatag

SEQ ID NO: 70501 - DNA, 18 bp, synthetic construct
  source 1..18: mol_type = other DNA
tttaacaactcacaatag

SEQ ID NO: 70502 - DNA, 18 bp, synthetic construct
  source 1..18: mol_type = other DNA
tttaacgactctatatag

SEQ ID NO: 70503 - DNA, 18 bp, synthetic construct
  source 1..18: mol_type = other DNA
tttaacgactctctctcg

SEQ ID NO: 70504 - DNA, 18 bp, synthetic construct
  source 1..18: mol_type = other DNA
tttaacgatgcactatag

SEQ ID NO: 70505 - DNA, 18 bp, synthetic construct
  source 1..18: mol_type = other DNA
tttaactacacacaatag

SEQ ID NO: 70506 - DNA, 18 bp, synthetic construct
  source 1..18: mol_type = other DNA
tttcacgtccctctatag

SEQ ID NO: 70507 - DNA, 18 bp, synthetic construct
  source 1..18: mol_type = other DNA
tttgacgactctctctag

SEQ ID NO: 70508 - DNA, 18 bp, synthetic construct
  source 1..18: mol_type = other DNA
ttttaagactcacactag

SEQ ID NO: 70509 - DNA, 18 bp, synthetic construct
  source 1..18: mol_type = other DNA
ttttaattctcaatttag

SEQ ID NO: 70510 - DNA, 18 bp, synthetic construct
  source 1..18: mol_type = other DNA
ttttacaacttactcaag

SEQ ID NO: 70511 - DNA, 18 bp, synthetic construct
  source 1..18: mol_type = other DNA
ttttacgactctatattg

SEQ ID NO: 70512 - DNA, 18 bp, synthetic construct
  source 1..18: mol_type = other DNA
ttttacgacttacacttg

SEQ ID NO: 70513 - DNA, 18 bp, synthetic construct
  source 1..18: mol_type = other DNA
ttttacgacttacattag

SEQ ID NO: 70514 - DNA, 18 bp, synthetic construct
  source 1..18: mol_type = other DNA
ttttacgattcaccgtag

SEQ ID NO: 70515 - DNA, 18 bp, synthetic construct
  source 1..18: mol_type = other DNA
ttttacgtctctgtatag

SEQ ID NO: 70516 - DNA, 18 bp, synthetic construct
  source 1..18: mol_type = other DNA
ttttacgttttactatag

SEQ ID NO: 70517 - DNA, 18 bp, synthetic construct
  source 1..18: mol_type = other DNA
ttttactactcacttaag

SEQ ID NO: 70518 - DNA, 18 bp, synthetic construct
  source 1..18: mol_type = other DNA
ttttatgactttctatgg

SEQ ID NO: 70519 - DNA, 18 bp, synthetic construct
  source 1..18: mol_type = other DNA
ttttcggactcactaaag

SEQ ID NO: 70520 - DNA, 18 bp, synthetic construct
  source 1..18: mol_type = other DNA
tttttcgacgcactacag

SEQ ID NO: 70521 - DNA, 18 bp, synthetic construct
  source 1..18: mol_type = other DNA
tttttcgattcataaaag

SEQ ID NO: 70522 - DNA, 18 bp, synthetic construct
  source 1..18: mol_type = other DNA
aataacgtctcactctag

SEQ ID NO: 70523 - DNA, 18 bp, synthetic construct
  source 1..18: mol_type = other DNA
taaaacctctcattttag

SEQ ID NO: 70524 - DNA, 18 bp, synthetic construct
  source 1..18: mol_type = other DNA
taataagtctcacataag

SEQ ID NO: 70525 - DNA, 18 bp, synthetic construct
  source 1..18: mol_type = other DNA
taatacaacctacttgag

SEQ ID NO: 70526 - DNA, 18 bp, synthetic construct
  source 1..18: mol_type = other DNA
tacttcgtctcacaaaag

SEQ ID NO: 70527 - DNA, 18 bp, synthetic construct
  source 1..18: mol_type = other DNA
tattacaacttacttttg

SEQ ID NO: 70528 - DNA, 18 bp, synthetic construct
  source 1..18: mol_type = other DNA
ttatactaatcacaattg

SEQ ID NO: 70529 - DNA, 18 bp, synthetic construct
  source 1..18: mol_type = other DNA
ttattcgacacacaaaag

SEQ ID NO: 70530 - DNA, 18 bp, synthetic construct
  source 1..18: mol_type = other DNA
ttgtatgtcacactatag

SEQ ID NO: 70531 - DNA, 18 bp, synthetic construct
  source 1..18: mol_type = other DNA
aaatacgtatcactcaag

SEQ ID NO: 70532 - DNA, 18 bp, synthetic construct
  source 1..18: mol_type = other DNA
aaattcgactttccatag

SEQ ID NO: 70533 - DNA, 18 bp, synthetic construct
  source 1..18: mol_type = other DNA
taatacatcacacaacag

SEQ ID NO: 70534 - DNA, 18 bp, synthetic construct
  source 1..18: mol_type = other DNA
taatacgtccctttgtag

SEQ ID NO: 70535 - DNA, 18 bp, synthetic construct
  source 1..18: mol_type = other DNA
taattcaactctttattg

SEQ ID NO: 70536 - DNA, 18 bp, synthetic construct
  source 1..18: mol_type = other DNA
taattctactcacataag

SEQ ID NO: 70537 - DNA, 18 bp, synthetic construct
  source 1..18: mol_type = other DNA
tattacttcaaactttag

SEQ ID NO: 70538 - DNA, 18 bp, synthetic construct
  source 1..18: mol_type = other DNA
ttattagactgactttag

SEQ ID NO: 70539 - DNA, 18 bp, synthetic construct
  source 1..18: mol_type = other DNA
aaaaaagattcattatag

SEQ ID NO: 70540 - DNA, 18 bp, synthetic construct
  source 1..18: mol_type = other DNA
aaaaacaactctctttag

SEQ ID NO: 70541 - DNA, 18 bp, synthetic construct
  source 1..18: mol_type = other DNA
aaaaaccactgacgatag

SEQ ID NO: 70542 - DNA, 18 bp, synthetic construct
  source 1..18: mol_type = other DNA
aaaaacgacactccatgg

SEQ ID NO: 70543 - DNA, 18 bp, synthetic construct
  source 1..18: mol_type = other DNA
aaaaacgacgctctttag

SEQ ID NO: 70544 - DNA, 18 bp, synthetic construct
  source 1..18: mol_type = other DNA
aaaaacgcatcactaatg

SEQ ID NO: 70545 - DNA, 18 bp, synthetic construct
  source 1..18: mol_type = other DNA
aaaaacggctatttatcg

SEQ ID NO: 70546 - DNA, 18 bp, synthetic construct
  source 1..18: mol_type = other DNA
aaaaacgtctaatattag

SEQ ID NO: 70547 - DNA, 18 bp, synthetic construct
  source 1..18: mol_type = other DNA
aaaaatgatacactatgg

SEQ ID NO: 70548 - DNA, 18 bp, synthetic construct
  source 1..18: mol_type = other DNA
aaacacctcgtactctag

SEQ ID NO: 70549 - DNA, 18 bp, synthetic construct
  source 1..18: mol_type = other DNA
aaacataacccaatatag

SEQ ID NO: 70550 - DNA, 18 bp, synthetic construct
  source 1..18: mol_type = other DNA
aaacgcgacaccaattag

SEQ ID NO: 70551 - DNA, 18 bp, synthetic construct
  source 1..18: mol_type = other DNA
aaagaagactcaccattg

SEQ ID NO: 70552 - DNA, 18 bp, synthetic construct
  source 1..18: mol_type = other DNA
aaataagactctttatgg

SEQ ID NO: 70553 - DNA, 18 bp, synthetic construct
  source 1..18: mol_type = other DNA
aaatacatctcactagtg

SEQ ID NO: 70554 - DNA, 18 bp, synthetic construct
  source 1..18: mol_type = other DNA
aaatacgacactcattag

SEQ ID NO: 70555 - DNA, 18 bp, synthetic construct
  source 1..18: mol_type = other DNA
aaatacgactcgacttag

SEQ ID NO: 70556 - DNA, 18 bp, synthetic construct
  source 1..18: mol_type = other DNA
aaatacgactctcttatg

SEQ ID NO: 70557 - DNA, 18 bp, synthetic construct
  source 1..18: mol_type = other DNA
aaatacgcttcacaattg

SEQ ID NO: 70558 - DNA, 18 bp, synthetic construct
  source 1..18: mol_type = other DNA
aaatacgtattactttag

SEQ ID NO: 70559 - DNA, 18 bp, synthetic construct
  source 1..18: mol_type = other DNA
aaataggactctcctttg

SEQ ID NO: 70560 - DNA, 18 bp, synthetic construct
  source 1..18: mol_type = other DNA
aaatatgactcgctcttg

SEQ ID NO: 70561 - DNA, 18 bp, synthetic construct
  source 1..18: mol_type = other DNA
aaatatgattctctaaag

SEQ ID NO: 70562 - DNA, 18 bp, synthetic construct
  source 1..18: mol_type = other DNA
aaatccctatcactatag

SEQ ID NO: 70563 - DNA, 18 bp, synthetic construct
  source 1..18: mol_type = other DNA
aaatccgtctttcttcag

SEQ ID NO: 70564 - DNA, 18 bp, synthetic construct
  source 1..18: mol_type = other DNA
aaatcgcagacactatag

SEQ ID NO: 70565 - DNA, 18 bp, synthetic construct
  source 1..18: mol_type = other DNA
aaatctttctcacgatcg

SEQ ID NO: 70566 - DNA, 18 bp, synthetic construct
  source 1..18: mol_type = other DNA
aaatgcaaaacactattg

SEQ ID NO: 70567 - DNA, 18 bp, synthetic construct
  source 1..18: mol_type = other DNA
aaatgcgcttcagtgtag

SEQ ID NO: 70568 - DNA, 18 bp, synthetic construct
  source 1..18: mol_type = other DNA
aaattccactccctttag

SEQ ID NO: 70569 - DNA, 18 bp, synthetic construct
  source 1..18: mol_type = other DNA
aaattcgacaatctatag

SEQ ID NO: 70570 - DNA, 18 bp, synthetic construct
  source 1..18: mol_type = other DNA
aaattcgacacacttaag

SEQ ID NO: 70571 - DNA, 18 bp, synthetic construct
  source 1..18: mol_type = other DNA
aaattcggctcacaaaag

SEQ ID NO: 70572 - DNA, 18 bp, synthetic construct
  source 1..18: mol_type = other DNA
aaattcgtcgtactaaag

SEQ ID NO: 70573 - DNA, 18 bp, synthetic construct
  source 1..18: mol_type = other DNA
aaattcgtttctcattag

SEQ ID NO: 70574 - DNA, 18 bp, synthetic construct
  source 1..18: mol_type = other DNA
aaattggtctccctatag

SEQ ID NO: 70575 - DNA, 18 bp, synthetic construct
  source 1..18: mol_type = other DNA
aactacgactaacaactg

SEQ ID NO: 70576 - DNA, 18 bp, synthetic construct
  source 1..18: mol_type = other DNA
aactacgactcagcagcg

SEQ ID NO: 70577 - DNA, 18 bp, synthetic construct
  source 1..18: mol_type = other DNA
aactacgacttacattag

SEQ ID NO: 70578 - DNA, 18 bp, synthetic construct
  source 1..18: mol_type = other DNA
aactacgtctaacatatg

SEQ ID NO: 70579 - DNA, 18 bp, synthetic construct
  source 1..18: mol_type = other DNA
aactacttctcagtcttg

SEQ ID NO: 70580 - DNA, 18 bp, synthetic construct
  source 1..18: mol_type = other DNA
aacttactttaactatag

SEQ ID NO: 70581 - DNA, 18 bp, synthetic construct
  source 1..18: mol_type = other DNA
aacttcatctgccaaaag

SEQ ID NO: 70582 - DNA, 18 bp, synthetic construct
  source 1..18: mol_type = other DNA
aactttgactcacaatag

SEQ ID NO: 70583 - DNA, 18 bp, synthetic construct
  source 1..18: mol_type = other DNA
aagatcgacacactatag

SEQ ID NO: 70584 - DNA, 18 bp, synthetic construct
  source 1..18: mol_type = other DNA
aagtacgaatctttatag

SEQ ID NO: 70585 - DNA, 18 bp, synthetic construct
  source 1..18: mol_type = other DNA
aagtacgattcatcatag

SEQ ID NO: 70586 - DNA, 18 bp, synthetic construct
  source 1..18: mol_type = other DNA
aataaagacttactagag

SEQ ID NO: 70587 - DNA, 18 bp, synthetic construct
  source 1..18: mol_type = other DNA
aataacgacacattaaag

SEQ ID NO: 70588 - DNA, 18 bp, synthetic construct
  source 1..18: mol_type = other DNA
aataaggactcactaaag

SEQ ID NO: 70589 - DNA, 18 bp, synthetic construct
  source 1..18: mol_type = other DNA
aatcacaactcactatcg

SEQ ID NO: 70590 - DNA, 18 bp, synthetic construct
  source 1..18: mol_type = other DNA
aattacaactccctgaag

SEQ ID NO: 70591 - DNA, 18 bp, synthetic construct
  source 1..18: mol_type = other DNA
aattaggcgtcactatag

SEQ ID NO: 70592 - DNA, 18 bp, synthetic construct
  source 1..18: mol_type = other DNA
aattattacccattacag

SEQ ID NO: 70593 - DNA, 18 bp, synthetic construct
  source 1..18: mol_type = other DNA
aattccgaattacaactg

SEQ ID NO: 70594 - DNA, 18 bp, synthetic construct
  source 1..18: mol_type = other DNA
aattgctgctcactatag

SEQ ID NO: 70595 - DNA, 18 bp, synthetic construct
  source 1..18: mol_type = other DNA
aatttcgactctttattg

SEQ ID NO: 70596 - DNA, 18 bp, synthetic construct
  source 1..18: mol_type = other DNA
acataccaaactctattg

SEQ ID NO: 70597 - DNA, 18 bp, synthetic construct
  source 1..18: mol_type = other DNA
acataccactcaatgtag

SEQ ID NO: 70598 - DNA, 18 bp, synthetic construct
  source 1..18: mol_type = other DNA
acatgagactaacaatag

SEQ ID NO: 70599 - DNA, 18 bp, synthetic construct
  source 1..18: mol_type = other DNA
agaaaaagctcagttaag

SEQ ID NO: 70600 - DNA, 18 bp, synthetic construct
  source 1..18: mol_type = other DNA
agaaacaacacactatag

SEQ ID NO: 70601 - DNA, 18 bp, synthetic construct
  source 1..18: mol_type = other DNA
agaaacgactctttattg

SEQ ID NO: 70602 - DNA, 18 bp, synthetic construct
  source 1..18: mol_type = other DNA
agaaccgactctctattg

SEQ ID NO: 70603 - DNA, 18 bp, synthetic construct
  source 1..18: mol_type = other DNA
agaatcgaatcactttag

SEQ ID NO: 70604 - DNA, 18 bp, synthetic construct
  source 1..18: mol_type = other DNA
agataagactaagtatag

SEQ ID NO: 70605 - DNA, 18 bp, synthetic construct
  source 1..18: mol_type = other DNA
agatacgactcaatttgg

SEQ ID NO: 70606 - DNA, 18 bp, synthetic construct
  source 1..18: mol_type = other DNA
agatacgtatcatactcg

SEQ ID NO: 70607 - DNA, 18 bp, synthetic construct
  source 1..18: mol_type = other DNA
agatacgtctcaatttag

SEQ ID NO: 70608 - DNA, 18 bp, synthetic construct
  source 1..18: mol_type = other DNA
agttacgactttctaaag

SEQ ID NO: 70609 - DNA, 18 bp, synthetic construct
  source 1..18: mol_type = other DNA
ataaacttcaccgtatcg

SEQ ID NO: 70610 - DNA, 18 bp, synthetic construct
  source 1..18: mol_type = other DNA
ataatcgacacactatag

SEQ ID NO: 70611 - DNA, 18 bp, synthetic construct
  source 1..18: mol_type = other DNA
atacgcatctcactatag

SEQ ID NO: 70612 - DNA, 18 bp, synthetic construct
  source 1..18: mol_type = other DNA
atatacgacacgctgtag

SEQ ID NO: 70613 - DNA, 18 bp, synthetic construct
  source 1..18: mol_type = other DNA
atataggactcccattag

SEQ ID NO: 70614 - DNA, 18 bp, synthetic construct
  source 1..18: mol_type = other DNA
atatatgactaaccatcg

SEQ ID NO: 70615 - DNA, 18 bp, synthetic construct
  source 1..18: mol_type = other DNA
atatatgactctttatag

SEQ ID NO: 70616 - DNA, 18 bp, synthetic construct
  source 1..18: mol_type = other DNA
atatattactccctatag

SEQ ID NO: 70617 - DNA, 18 bp, synthetic construct
  source 1..18: mol_type = other DNA
atatccgatagattttag

SEQ ID NO: 70618 - DNA, 18 bp, synthetic construct
  source 1..18: mol_type = other DNA
atatgcgaataactttag

SEQ ID NO: 70619 - DNA, 18 bp, synthetic construct
  source 1..18: mol_type = other DNA
atatgctactcactaaag

SEQ ID NO: 70620 - DNA, 18 bp, synthetic construct
  source 1..18: mol_type = other DNA
atattcgacttactaaag

SEQ ID NO: 70621 - DNA, 18 bp, synthetic construct
  source 1..18: mol_type = other DNA
atcttcttctaacaatag

SEQ ID NO: 70622 - DNA, 18 bp, synthetic construct
  source 1..18: mol_type = other DNA
atggatgtcccaccatag

SEQ ID NO: 70623 - DNA, 18 bp, synthetic construct
  source 1..18: mol_type = other DNA
atgttatactcacaaaag

SEQ ID NO: 70624 - DNA, 18 bp, synthetic construct
  source 1..18: mol_type = other DNA
attaacgactaactatag

SEQ ID NO: 70625 - DNA, 18 bp, synthetic construct
  source 1..18: mol_type = other DNA
atttacgactctctttag

SEQ ID NO: 70626 - DNA, 18 bp, synthetic construct
  source 1..18: mol_type = other DNA
atttccgactcgctaaag

SEQ ID NO: 70627 - DNA, 18 bp, synthetic construct
  source 1..18: mol_type = other DNA
atttgcgactcattaaag

SEQ ID NO: 70628 - DNA, 18 bp, synthetic construct
  source 1..18: mol_type = other DNA
attttcaactcactatag

SEQ ID NO: 70629 - DNA, 18 bp, synthetic construct
  source 1..18: mol_type = other DNA
caaaaccactcgcaatag

SEQ ID NO: 70630 - DNA, 18 bp, synthetic construct
  source 1..18: mol_type = other DNA
caactcgactatgatttg

SEQ ID NO: 70631 - DNA, 18 bp, synthetic construct
  source 1..18: mol_type = other DNA
caatacgatatcccatag

SEQ ID NO: 70632 - DNA, 18 bp, synthetic construct
  source 1..18: mol_type = other DNA
caatacgtctaacattag

SEQ ID NO: 70633 - DNA, 18 bp, synthetic construct
  source 1..18: mol_type = other DNA
caatgcgtctcactagtg

SEQ ID NO: 70634 - DNA, 18 bp, synthetic construct
  source 1..18: mol_type = other DNA
caattcgactcacatttg

SEQ ID NO: 70635 - DNA, 18 bp, synthetic construct
  source 1..18: mol_type = other DNA
caattcgtctctcaaacg

SEQ ID NO: 70636 - DNA, 18 bp, synthetic construct
  source 1..18: mol_type = other DNA
cactaatacttacgctag

SEQ ID NO: 70637 - DNA, 18 bp, synthetic construct
  source 1..18: mol_type = other DNA
cactacgcctgtctatag

SEQ ID NO: 70638 - DNA, 18 bp, synthetic construct
  source 1..18: mol_type = other DNA
cagtaaaccaaactatag

SEQ ID NO: 70639 - DNA, 18 bp, synthetic construct
  source 1..18: mol_type = other DNA
cagtacaattatctaaag

SEQ ID NO: 70640 - DNA, 18 bp, synthetic construct
  source 1..18: mol_type = other DNA
cagtacgactatctttag

SEQ ID NO: 70641 - DNA, 18 bp, synthetic construct
  source 1..18: mol_type = other DNA
cataacgacgcactttag

SEQ ID NO: 70642 - DNA, 18 bp, synthetic construct
  source 1..18: mol_type = other DNA
cattaactctcacattag

SEQ ID NO: 70643 - DNA, 18 bp, synthetic construct
  source 1..18: mol_type = other DNA
cattaccactaacaatag

SEQ ID NO: 70644 - DNA, 18 bp, synthetic construct
  source 1..18: mol_type = other DNA
cattacggtacactatag

SEQ ID NO: 70645 - DNA, 18 bp, synthetic construct
  source 1..18: mol_type = other DNA
cattactactcaccattg

SEQ ID NO: 70646 - DNA, 18 bp, synthetic construct
  source 1..18: mol_type = other DNA
ccatacgaccgaatatag

SEQ ID NO: 70647 - DNA, 18 bp, synthetic construct
  source 1..18: mol_type = other DNA
ccatgcgaattagtatcg

SEQ ID NO: 70648 - DNA, 18 bp, synthetic construct
  source 1..18: mol_type = other DNA
cgaataggcttaatctag

SEQ ID NO: 70649 - DNA, 18 bp, synthetic construct
  source 1..18: mol_type = other DNA
cgatacgactctcattcg

SEQ ID NO: 70650 - DNA, 18 bp, synthetic construct
  source 1..18: mol_type = other DNA
ctaaacgactcactaatg

SEQ ID NO: 70651 - DNA, 18 bp, synthetic construct
  source 1..18: mol_type = other DNA
ctaaacgactcactcgag

SEQ ID NO: 70652 - DNA, 18 bp, synthetic construct
  source 1..18: mol_type = other DNA
ctaatcgactcagtaaag

SEQ ID NO: 70653 - DNA, 18 bp, synthetic construct
  source 1..18: mol_type = other DNA
ctacacatcacacactag

SEQ ID NO: 70654 - DNA, 18 bp, synthetic construct
  source 1..18: mol_type = other DNA
ctatacaactcacttaag

SEQ ID NO: 70655 - DNA, 18 bp, synthetic construct
  source 1..18: mol_type = other DNA
ctatacgattctcaatcg

SEQ ID NO: 70656 - DNA, 18 bp, synthetic construct
  source 1..18: mol_type = other DNA
ctatatgactcacaatgg

SEQ ID NO: 70657 - DNA, 18 bp, synthetic construct
  source 1..18: mol_type = other DNA
ctattcgacacactactg

SEQ ID NO: 70658 - DNA, 18 bp, synthetic construct
  source 1..18: mol_type = other DNA
ctcaacgactcacactag

SEQ ID NO: 70659 - DNA, 18 bp, synthetic construct
  source 1..18: mol_type = other DNA
ctgtaagacattcaaaag

SEQ ID NO: 70660 - DNA, 18 bp, synthetic construct
  source 1..18: mol_type = other DNA
ctttacgacgcagcatag

SEQ ID NO: 70661 - DNA, 18 bp, synthetic construct
  source 1..18: mol_type = other DNA
ctttacgtctctctattg

SEQ ID NO: 70662 - DNA, 18 bp, synthetic construct
  source 1..18: mol_type = other DNA
cttttccactcactgtag

SEQ ID NO: 70663 - DNA, 18 bp, synthetic construct
  source 1..18: mol_type = other DNA
gaataagtctctatacag

SEQ ID NO: 70664 - DNA, 18 bp, synthetic construct
  source 1..18: mol_type = other DNA
gaatacgacatactcctg

SEQ ID NO: 70665 - DNA, 18 bp, synthetic construct
  source 1..18: mol_type = other DNA
gaataggacacattacag

SEQ ID NO: 70666 - DNA, 18 bp, synthetic construct
  source 1..18: mol_type = other DNA
gaatccgacacacttttg

SEQ ID NO: 70667 - DNA, 18 bp, synthetic construct
  source 1..18: mol_type = other DNA
gaatgaaacacactatag

SEQ ID NO: 70668 - DNA, 18 bp, synthetic construct
  source 1..18: mol_type = other DNA
gaattctaatccctgtag

SEQ ID NO: 70669 - DNA, 18 bp, synthetic construct
  source 1..18: mol_type = other DNA
gaattggcctcactgaag

SEQ ID NO: 70670 - DNA, 18 bp, synthetic construct
  source 1..18: mol_type = other DNA
gcatacggctcattagag

SEQ ID NO: 70671 - DNA, 18 bp, synthetic construct
  source 1..18: mol_type = other DNA
ggatacgacaccctacag

SEQ ID NO: 70672 - DNA, 18 bp, synthetic construct
  source 1..18: mol_type = other DNA
gtacacccctaactttag

SEQ ID NO: 70673 - DNA, 18 bp, synthetic construct
  source 1..18: mol_type = other DNA
gtatccaacttactatag

SEQ ID NO: 70674 - DNA, 18 bp, synthetic construct
  source 1..18: mol_type = other DNA
gtattcgtcactccatag

SEQ ID NO: 70675 - DNA, 18 bp, synthetic construct
  source 1..18: mol_type = other DNA
gttaacgactcgctatag

SEQ ID NO: 70676 - DNA, 18 bp, synthetic construct
  source 1..18: mol_type = other DNA
gttttcgaaacactatag

SEQ ID NO: 70677 - DNA, 18 bp, synthetic construct
  source 1..18: mol_type = other DNA
taaaaagacttacttatg

SEQ ID NO: 70678 - DNA, 18 bp, synthetic construct
  source 1..18: mol_type = other DNA
taaaaagtcttaacatag

SEQ ID NO: 70679 - DNA, 18 bp, synthetic construct
  source 1..18: mol_type = other DNA
taaaaatactcatttaag

SEQ ID NO: 70680 - DNA, 18 bp, synthetic construct
  source 1..18: mol_type = other DNA
taaaacaacccagtattg

SEQ ID NO: 70681 - DNA, 18 bp, synthetic construct
  source 1..18: mol_type = other DNA
taaaacatctcattattg

SEQ ID NO: 70682 - DNA, 18 bp, synthetic construct
  source 1..18: mol_type = other DNA
taaaaccaatcatttcag

SEQ ID NO: 70683 - DNA, 18 bp, synthetic construct
  source 1..18: mol_type = other DNA
taaaacgacacagattag

SEQ ID NO: 70684 - DNA, 18 bp, synthetic construct
  source 1..18: mol_type = other DNA
taaaacgactaattcttg

SEQ ID NO: 70685 - DNA, 18 bp, synthetic construct
  source 1..18: mol_type = other DNA
taaaacgactagataaag

SEQ ID NO: 70686 - DNA, 18 bp, synthetic construct
  source 1..18: mol_type = other DNA
taaaacgactctttccag

SEQ ID NO: 70687 - DNA, 18 bp, synthetic construct
  source 1..18: mol_type = other DNA
taaaacgatactctttag

SEQ ID NO: 70688 - DNA, 18 bp, synthetic construct
  source 1..18: mol_type = other DNA
taaaacgattctatttag

SEQ ID NO: 70689 - DNA, 18 bp, synthetic construct
  source 1..18: mol_type = other DNA
taaaacgattctctcaag

SEQ ID NO: 70690 - DNA, 18 bp, synthetic construct
  source 1..18: mol_type = other DNA
taaaacggcacacaatgg

SEQ ID NO: 70691 - DNA, 18 bp, synthetic construct
  source 1..18: mol_type = other DNA
taaaacgtattattatcg

SEQ ID NO: 70692 - DNA, 18 bp, synthetic construct
  source 1..18: mol_type = other DNA
taaaacgtctcacatagg

SEQ ID NO: 70693 - DNA, 18 bp, synthetic construct
  source 1..18: mol_type = other DNA
taaaacgtctttatatag

SEQ ID NO: 70694 - DNA, 18 bp, synthetic construct
  source 1..18: mol_type = other DNA
taaaactactgacattag

SEQ ID NO: 70695 - DNA, 18 bp, synthetic construct
  source 1..18: mol_type = other DNA
taaaactccacaatatcg

SEQ ID NO: 70696 - DNA, 18 bp, synthetic construct
  source 1..18: mol_type = other DNA
taaaacttctcgcttatg

SEQ ID NO: 70697 - DNA, 18 bp, synthetic construct
  source 1..18: mol_type = other DNA
taaaagaacttactttcg

SEQ ID NO: 70698 - DNA, 18 bp, synthetic construct
  source 1..18: mol_type = other DNA
taaaaggacactcttaag

SEQ ID NO: 70699 - DNA, 18 bp, synthetic construct
  source 1..18: mol_type = other DNA
taaaaggcttcgctatag

SEQ ID NO: 70700 - DNA, 18 bp, synthetic construct
  source 1..18: mol_type = other DNA
taaaatgaccaagtattg

SEQ ID NO: 70701 - DNA, 18 bp, synthetic construct
  source 1..18: mol_type = other DNA
taaaattactctttatag

SEQ ID NO: 70702 - DNA, 18 bp, synthetic construct
  source 1..18: mol_type = other DNA
taaaccgattcagcatag

SEQ ID NO: 70703 - DNA, 18 bp, synthetic construct
  source 1..18: mol_type = other DNA
taaagaggctcaattttg

SEQ ID NO: 70704 - DNA, 18 bp, synthetic construct
  source 1..18: mol_type = other DNA
taaagcgaatcacaattg

SEQ ID NO: 70705 - DNA, 18 bp, synthetic construct
  source 1..18: mol_type = other DNA
taaagcgacacattattg

SEQ ID NO: 70706 - DNA, 18 bp, synthetic construct
  source 1..18: mol_type = other DNA
taaagcgacatacaatag

SEQ ID NO: 70707 - DNA, 18 bp, synthetic construct
  source 1..18: mol_type = other DNA
taaatacacccactaaag

SEQ ID NO: 70708 - DNA, 18 bp, synthetic construct
  source 1..18: mol_type = other DNA
taaatagcctctctttag

SEQ ID NO: 70709 - DNA, 18 bp, synthetic construct
  source 1..18: mol_type = other DNA
taaatagccttaccagag

SEQ ID NO: 70710 - DNA, 18 bp, synthetic construct
  source 1..18: mol_type = other DNA
taaatatactgccaacag

SEQ ID NO: 70711 - DNA, 18 bp, synthetic construct
  source 1..18: mol_type = other DNA
taaatcaacgccataaag

SEQ ID NO: 70712 - DNA, 18 bp, synthetic construct
  source 1..18: mol_type = other DNA
taaatcaactcacaatcg

SEQ ID NO: 70713 - DNA, 18 bp, synthetic construct
  source 1..18: mol_type = other DNA
taaatcaagacactatag

SEQ ID NO: 70714 - DNA, 18 bp, synthetic construct
  source 1..18: mol_type = other DNA
taaatcgacacacttaag

SEQ ID NO: 70715 - DNA, 18 bp, synthetic construct
  source 1..18: mol_type = other DNA
taaatcgacgctctaatg

SEQ ID NO: 70716 - DNA, 18 bp, synthetic construct
  source 1..18: mol_type = other DNA
taaatcgactcactcatg

SEQ ID NO: 70717 - DNA, 18 bp, synthetic construct
  source 1..18: mol_type = other DNA
taaatcgattcattattg

SEQ ID NO: 70718 - DNA, 18 bp, synthetic construct
  source 1..18: mol_type = other DNA
taacaacactaacataag

SEQ ID NO: 70719 - DNA, 18 bp, synthetic construct
  source 1..18: mol_type = other DNA
taacaagacaccttatag

SEQ ID NO: 70720 - DNA, 18 bp, synthetic construct
  source 1..18: mol_type = other DNA
taacaagacctacaatag

SEQ ID NO: 70721 - DNA, 18 bp, synthetic construct
  source 1..18: mol_type = other DNA
taacaagtctcacttttg

SEQ ID NO: 70722 - DNA, 18 bp, synthetic construct
  source 1..18: mol_type = other DNA
taacaagtttcacaattg

SEQ ID NO: 70723 - DNA, 18 bp, synthetic construct
  source 1..18: mol_type = other DNA
taacaatactcacttctg

SEQ ID NO: 70724 - DNA, 18 bp, synthetic construct
  source 1..18: mol_type = other DNA
taacacaacacattattg

SEQ ID NO: 70725 - DNA, 18 bp, synthetic construct
  source 1..18: mol_type = other DNA
taacacaacattgcatag

SEQ ID NO: 70726 - DNA, 18 bp, synthetic construct
  source 1..18: mol_type = other DNA
taacacgtcacagcatag

SEQ ID NO: 70727 - DNA, 18 bp, synthetic construct
  source 1..18: mol_type = other DNA
taacacgtcaccctctag

SEQ ID NO: 70728 - DNA, 18 bp, synthetic construct
  source 1..18: mol_type = other DNA
taacacgtttaaaataag

SEQ ID NO: 70729 - DNA, 18 bp, synthetic construct
  source 1..18: mol_type = other DNA
taacatgacacacatttg

SEQ ID NO: 70730 - DNA, 18 bp, synthetic construct
  source 1..18: mol_type = other DNA
taacatggcacactatgg

SEQ ID NO: 70731 - DNA, 18 bp, synthetic construct
  source 1..18: mol_type = other DNA
taacatgtttcactacag

SEQ ID NO: 70732 - DNA, 18 bp, synthetic construct
  source 1..18: mol_type = other DNA
taacccgtctctctttag

SEQ ID NO: 70733 - DNA, 18 bp, synthetic construct
  source 1..18: mol_type = other DNA
taactatattcactattg

SEQ ID NO: 70734 - DNA, 18 bp, synthetic construct
  source 1..18: mol_type = other DNA
taactcgactcagcattg

SEQ ID NO: 70735 - DNA, 18 bp, synthetic construct
  source 1..18: mol_type = other DNA
taactcgtcacattgaag

SEQ ID NO: 70736 - DNA, 18 bp, synthetic construct
  source 1..18: mol_type = other DNA
taactcttctctcataag

SEQ ID NO: 70737 - DNA, 18 bp, synthetic construct
  source 1..18: mol_type = other DNA
taactggtatcactaaag

SEQ ID NO: 70738 - DNA, 18 bp, synthetic construct
  source 1..18: mol_type = other DNA
taagaccactctattaag

SEQ ID NO: 70739 - DNA, 18 bp, synthetic construct
  source 1..18: mol_type = other DNA
taagacgatactatgcag

SEQ ID NO: 70740 - DNA, 18 bp, synthetic construct
  source 1..18: mol_type = other DNA
taagacttctctctatgg

SEQ ID NO: 70741 - DNA, 18 bp, synthetic construct
  source 1..18: mol_type = other DNA
taataaaatccactatcg

SEQ ID NO: 70742 - DNA, 18 bp, synthetic construct
  source 1..18: mol_type = other DNA
taataacactaacttttg

SEQ ID NO: 70743 - DNA, 18 bp, synthetic construct
  source 1..18: mol_type = other DNA
taataagactaacttatg

SEQ ID NO: 70744 - DNA, 18 bp, synthetic construct
  source 1..18: mol_type = other DNA
taataagactcaatgggg

SEQ ID NO: 70745 - DNA, 18 bp, synthetic construct
  source 1..18: mol_type = other DNA
taataagactctcttccg

SEQ ID NO: 70746 - DNA, 18 bp, synthetic construct
  source 1..18: mol_type = other DNA
taataagatactctttag

SEQ ID NO: 70747 - DNA, 18 bp, synthetic construct
  source 1..18: mol_type = other DNA
taatacaacacatatttg

SEQ ID NO: 70748 - DNA, 18 bp, synthetic construct
  source 1..18: mol_type = other DNA
taatacaactctctcatg

SEQ ID NO: 70749 - DNA, 18 bp, synthetic construct
  source 1..18: mol_type = other DNA
taatacaagtcgctatca

SEQ ID NO: 70750 - DNA, 18 bp, synthetic construct
  source 1..18: mol_type = other DNA
taatacactatcttctag

SEQ ID NO: 70751 - DNA, 18 bp, synthetic construct
  source 1..18: mol_type = other DNA
taatacatccgactaaag

SEQ ID NO: 70752 - DNA, 18 bp, synthetic construct
  source 1..18: mol_type = other DNA
taatacatctctcaaaag

SEQ ID NO: 70753 - DNA, 18 bp, synthetic construct
  source 1..18: mol_type = other DNA
taatacatcttaatacag

SEQ ID NO: 70754 - DNA, 18 bp, synthetic construct
  source 1..18: mol_type = other DNA
taataccacaatcaatag

SEQ ID NO: 70755 - DNA, 18 bp, synthetic construct
  source 1..18: mol_type = other DNA
taataccacatacttttg

SEQ ID NO: 70756 - DNA, 18 bp, synthetic construct
  source 1..18: mol_type = other DNA
taataccactcctttatg

SEQ ID NO: 70757 - DNA, 18 bp, synthetic construct
  source 1..18: mol_type = other DNA
taatacgaaattatatag

SEQ ID NO: 70758 - DNA, 18 bp, synthetic construct
  source 1..18: mol_type = other DNA
taatacgactgtcttatg

SEQ ID NO: 70759 - DNA, 18 bp, synthetic construct
  source 1..18: mol_type = other DNA
taatacgagcttcttttg

SEQ ID NO: 70760 - DNA, 18 bp, synthetic construct
  source 1..18: mol_type = other DNA
taatacgagtctcgagtg

SEQ ID NO: 70761 - DNA, 18 bp, synthetic construct
  source 1..18: mol_type = other DNA
taatacgatactatattg

SEQ ID NO: 70762 - DNA, 18 bp, synthetic construct
  source 1..18: mol_type = other DNA
taatacgatcctacatag

SEQ ID NO: 70763 - DNA, 18 bp, synthetic construct
  source 1..18: mol_type = other DNA
taatacgatgtaacaaag

SEQ ID NO: 70764 - DNA, 18 bp, synthetic construct
  source 1..18: mol_type = other DNA
taatacgattcacatacg

SEQ ID NO: 70765 - DNA, 18 bp, synthetic construct
  source 1..18: mol_type = other DNA
taatacgcttcattttcg

SEQ ID NO: 70766 - DNA, 18 bp, synthetic construct
  source 1..18: mol_type = other DNA
taatacggctctcccttg

SEQ ID NO: 70767 - DNA, 18 bp, synthetic construct
  source 1..18: mol_type = other DNA
taatacgtatatcaatag

SEQ ID NO: 70768 - DNA, 18 bp, synthetic construct
  source 1..18: mol_type = other DNA
taatacgtctcaattctg

SEQ ID NO: 70769 - DNA, 18 bp, synthetic construct
  source 1..18: mol_type = other DNA
taatacgtctccttttcg

SEQ ID NO: 70770 - DNA, 18 bp, synthetic construct
  source 1..18: mol_type = other DNA
taatacgtctctatgttg

SEQ ID NO: 70771 - DNA, 18 bp, synthetic construct
  source 1..18: mol_type = other DNA
taatacgtcttgcttgag

SEQ ID NO: 70772 - DNA, 18 bp, synthetic construct
  source 1..18: mol_type = other DNA
taatacgttacataatag

SEQ ID NO: 70773 - DNA, 18 bp, synthetic construct
  source 1..18: mol_type = other DNA
taatacgttactcaatag

SEQ ID NO: 70774 - DNA, 18 bp, synthetic construct
  source 1..18: mol_type = other DNA
taatacgttagaatatag

SEQ ID NO: 70775 - DNA, 18 bp, synthetic construct
  source 1..18: mol_type = other DNA
taatacgtttagctattg

SEQ ID NO: 70776 - DNA, 18 bp, synthetic construct
  source 1..18: mol_type = other DNA
taatacgtttccttacag

SEQ ID NO: 70777 - DNA, 18 bp, synthetic construct
  source 1..18: mol_type = other DNA
taatacgtttctcttaag

SEQ ID NO: 70778 - DNA, 18 bp, synthetic construct
  source 1..18: mol_type = other DNA
taatactaatgtcgattg

SEQ ID NO: 70779 - DNA, 18 bp, synthetic construct
  source 1..18: mol_type = other DNA
taatactacagtctagtg

SEQ ID NO: 70780 - DNA, 18 bp, synthetic construct
  source 1..18: mol_type = other DNA
taatacttatcgctattg

SEQ ID NO: 70781 - DNA, 18 bp, synthetic construct
  source 1..18: mol_type = other DNA
taatacttcccaccttag

SEQ ID NO: 70782 - DNA, 18 bp, synthetic construct
  source 1..18: mol_type = other DNA
taatacttctcacaaatg

SEQ ID NO: 70783 - DNA, 18 bp, synthetic construct
  source 1..18: mol_type = other DNA
taatacttctgtccctag

SEQ ID NO: 70784 - DNA, 18 bp, synthetic construct
  source 1..18: mol_type = other DNA
taatactttgcactcttg

SEQ ID NO: 70785 - DNA, 18 bp, synthetic construct
  source 1..18: mol_type = other DNA
taataggaatcactcgtg

SEQ ID NO: 70786 - DNA, 18 bp, synthetic construct
  source 1..18: mol_type = other DNA
taataggatacaccgaag

SEQ ID NO: 70787 - DNA, 18 bp, synthetic construct
  source 1..18: mol_type = other DNA
taataggtcacactaatg

SEQ ID NO: 70788 - DNA, 18 bp, synthetic construct
  source 1..18: mol_type = other DNA
taataggttttactttag

SEQ ID NO: 70789 - DNA, 18 bp, synthetic construct
  source 1..18: mol_type = other DNA
taatatacattcccattg

SEQ ID NO: 70790 - DNA, 18 bp, synthetic construct
  source 1..18: mol_type = other DNA
taatatcgctcaatcaag

SEQ ID NO: 70791 - DNA, 18 bp, synthetic construct
  source 1..18: mol_type = other DNA
taatatgtctcacatttg

SEQ ID NO: 70792 - DNA, 18 bp, synthetic construct
  source 1..18: mol_type = other DNA
taatatgtctttatatag

SEQ ID NO: 70793 - DNA, 18 bp, synthetic construct
  source 1..18: mol_type = other DNA
taatattatacacattgg

SEQ ID NO: 70794 - DNA, 18 bp, synthetic construct
  source 1..18: mol_type = other DNA
taatattattctctattg

SEQ ID NO: 70795 - DNA, 18 bp, synthetic construct
  source 1..18: mol_type = other DNA
taatcaaacgcactgtag

SEQ ID NO: 70796 - DNA, 18 bp, synthetic construct
  source 1..18: mol_type = other DNA
taatcagtctttctatag

SEQ ID NO: 70797 - DNA, 18 bp, synthetic construct
  source 1..18: mol_type = other DNA
taatccaaatctgttacg

SEQ ID NO: 70798 - DNA, 18 bp, synthetic construct
  source 1..18: mol_type = other DNA
taatccaacttacaattg

SEQ ID NO: 70799 - DNA, 18 bp, synthetic construct
  source 1..18: mol_type = other DNA
taatccatctctctgtag

SEQ ID NO: 70800 - DNA, 18 bp, synthetic construct
  source 1..18: mol_type = other DNA
taatccgaatcacctatg

SEQ ID NO: 70801 - DNA, 18 bp, synthetic construct
  source 1..18: mol_type = other DNA
taatccgacacacttacg

SEQ ID NO: 70802 - DNA, 18 bp, synthetic construct
  source 1..18: mol_type = other DNA
taatccgattatctttag

SEQ ID NO: 70803 - DNA, 18 bp, synthetic construct
  source 1..18: mol_type = other DNA
taatccgtcacacttaag

SEQ ID NO: 70804 - DNA, 18 bp, synthetic construct
  source 1..18: mol_type = other DNA
taatcctattgactctcg

SEQ ID NO: 70805 - DNA, 18 bp, synthetic construct
  source 1..18: mol_type = other DNA
taatctgtctccctaaag

SEQ ID NO: 70806 - DNA, 18 bp, synthetic construct
  source 1..18: mol_type = other DNA
taatgagtctaactattg

SEQ ID NO: 70807 - DNA, 18 bp, synthetic construct
  source 1..18: mol_type = other DNA
taatgcaacacacataag

SEQ ID NO: 70808 - DNA, 18 bp, synthetic construct
  source 1..18: mol_type = other DNA
taatgcgaaggacagtag

SEQ ID NO: 70809 - DNA, 18 bp, synthetic construct
  source 1..18: mol_type = other DNA
taatgctatacgctatag

SEQ ID NO: 70810 - DNA, 18 bp, synthetic construct
  source 1..18: mol_type = other DNA
taatgtacctcaatatag

SEQ ID NO: 70811 - DNA, 18 bp, synthetic construct
  source 1..18: mol_type = other DNA
taatgtatctcactacag

SEQ ID NO: 70812 - DNA, 18 bp, synthetic construct
  source 1..18: mol_type = other DNA
taattaaactatctatag

SEQ ID NO: 70813 - DNA, 18 bp, synthetic construct
  source 1..18: mol_type = other DNA
taattagactcacaaacg

SEQ ID NO: 70814 - DNA, 18 bp, synthetic construct
  source 1..18: mol_type = other DNA
taattagactctttttag

SEQ ID NO: 70815 - DNA, 18 bp, synthetic construct
  source 1..18: mol_type = other DNA
taattagctacactatgg

SEQ ID NO: 70816 - DNA, 18 bp, synthetic construct
  source 1..18: mol_type = other DNA
taattcaacacaatatgg

SEQ ID NO: 70817 - DNA, 18 bp, synthetic construct
  source 1..18: mol_type = other DNA
taattcaacacacagtag

SEQ ID NO: 70818 - DNA, 18 bp, synthetic construct
  source 1..18: mol_type = other DNA
taattcaactcaaattag

SEQ ID NO: 70819 - DNA, 18 bp, synthetic construct
  source 1..18: mol_type = other DNA
taattcaactcataaaag

SEQ ID NO: 70820 - DNA, 18 bp, synthetic construct
  source 1..18: mol_type = other DNA
taattcaagtcagtattg

SEQ ID NO: 70821 - DNA, 18 bp, synthetic construct
  source 1..18: mol_type = other DNA
taattcatctcactcttg

SEQ ID NO: 70822 - DNA, 18 bp, synthetic construct
  source 1..18: mol_type = other DNA
taattcatctcccattag

SEQ ID NO: 70823 - DNA, 18 bp, synthetic construct
  source 1..18: mol_type = other DNA
taattcatctctctttag

SEQ ID NO: 70824 - DNA, 18 bp, synthetic construct
  source 1..18: mol_type = other DNA
taattcatcttactattg

SEQ ID NO: 70825 - DNA, 18 bp, synthetic construct
  source 1..18: mol_type = other DNA
taattcgaactacagtag

SEQ ID NO: 70826 - DNA, 18 bp, synthetic construct
  source 1..18: mol_type = other DNA
taattcgaatcacattgg

SEQ ID NO: 70827 - DNA, 18 bp, synthetic construct
  source 1..18: mol_type = other DNA
taattcgacatgcagttg

SEQ ID NO: 70828 - DNA, 18 bp, synthetic construct
  source 1..18: mol_type = other DNA
taattcgtcaacctatcg

SEQ ID NO: 70829 - DNA, 18 bp, synthetic construct
  source 1..18: mol_type = other DNA
taattcgtccctcaatag

SEQ ID NO: 70830 - DNA, 18 bp, synthetic construct
  source 1..18: mol_type = other DNA
taattcgtctccataaag

SEQ ID NO: 70831 - DNA, 18 bp, synthetic construct
  source 1..18: mol_type = other DNA
taattcgtctctcgaatg

SEQ ID NO: 70832 - DNA, 18 bp, synthetic construct
  source 1..18: mol_type = other DNA
taattctaatcattattg

SEQ ID NO: 70833 - DNA, 18 bp, synthetic construct
  source 1..18: mol_type = other DNA
taattctacacacaattg

SEQ ID NO: 70834 - DNA, 18 bp, synthetic construct
  source 1..18: mol_type = other DNA
taattctactcatttaag

SEQ ID NO: 70835 - DNA, 18 bp, synthetic construct
  source 1..18: mol_type = other DNA
taattctactctatctag

SEQ ID NO: 70836 - DNA, 18 bp, synthetic construct
  source 1..18: mol_type = other DNA
taattcttctaactctag

SEQ ID NO: 70837 - DNA, 18 bp, synthetic construct
  source 1..18: mol_type = other DNA
taatttgaatcacattag

SEQ ID NO: 70838 - DNA, 18 bp, synthetic construct
  source 1..18: mol_type = other DNA
taatttgaatcattatga

SEQ ID NO: 70839 - DNA, 18 bp, synthetic construct
  source 1..18: mol_type = other DNA
taatttgagtcactcaag

SEQ ID NO: 70840 - DNA, 18 bp, synthetic construct
  source 1..18: mol_type = other DNA
taatttgcctaactattg

SEQ ID NO: 70841 - DNA, 18 bp, synthetic construct
  source 1..18: mol_type = other DNA
tacaacgaggccctatag

SEQ ID NO: 70842 - DNA, 18 bp, synthetic construct
  source 1..18: mol_type = other DNA
tactaagattcacaatgg

SEQ ID NO: 70843 - DNA, 18 bp, synthetic construct
  source 1..18: mol_type = other DNA
tactaagtctctctttcg

SEQ ID NO: 70844 - DNA, 18 bp, synthetic construct
  source 1..18: mol_type = other DNA
tactacaatacattatag

SEQ ID NO: 70845 - DNA, 18 bp, synthetic construct
  source 1..18: mol_type = other DNA
tactacctctcactgtgg

SEQ ID NO: 70846 - DNA, 18 bp, synthetic construct
  source 1..18: mol_type = other DNA
tactactacacacatttg

SEQ ID NO: 70847 - DNA, 18 bp, synthetic construct
  source 1..18: mol_type = other DNA
tactatcactaattgtgg

SEQ ID NO: 70848 - DNA, 18 bp, synthetic construct
  source 1..18: mol_type = other DNA
tactctgactcacgttag

SEQ ID NO: 70849 - DNA, 18 bp, synthetic construct
  source 1..18: mol_type = other DNA
tactgcgactcgcttgag

SEQ ID NO: 70850 - DNA, 18 bp, synthetic construct
  source 1..18: mol_type = other DNA
tacttattctctcaattg

SEQ ID NO: 70851 - DNA, 18 bp, synthetic construct
  source 1..18: mol_type = other DNA
tacttcgattcacttaag

SEQ ID NO: 70852 - DNA, 18 bp, synthetic construct
  source 1..18: mol_type = other DNA
tacttcgcatctctttag

SEQ ID NO: 70853 - DNA, 18 bp, synthetic construct
  source 1..18: mol_type = other DNA
tacttttactcacttaag

SEQ ID NO: 70854 - DNA, 18 bp, synthetic construct
  source 1..18: mol_type = other DNA
tagaacgattccctacag

SEQ ID NO: 70855 - DNA, 18 bp, synthetic construct
  source 1..18: mol_type = other DNA
tagcacaacgcactcttg

SEQ ID NO: 70856 - DNA, 18 bp, synthetic construct
  source 1..18: mol_type = other DNA
tagcacgagtctctattg

SEQ ID NO: 70857 - DNA, 18 bp, synthetic construct
  source 1..18: mol_type = other DNA
tagtaccacttattattg

SEQ ID NO: 70858 - DNA, 18 bp, synthetic construct
  source 1..18: mol_type = other DNA
tagtacgactcaattccg

SEQ ID NO: 70859 - DNA, 18 bp, synthetic construct
  source 1..18: mol_type = other DNA
tagtacgacttagctaag

SEQ ID NO: 70860 - DNA, 18 bp, synthetic construct
  source 1..18: mol_type = other DNA
tagtactatcagctatag

SEQ ID NO: 70861 - DNA, 18 bp, synthetic construct
  source 1..18: mol_type = other DNA
tagtacttctcacatttg

SEQ ID NO: 70862 - DNA, 18 bp, synthetic construct
  source 1..18: mol_type = other DNA
tagtagatttcatttaag

SEQ ID NO: 70863 - DNA, 18 bp, synthetic construct
  source 1..18: mol_type = other DNA
tagtatgacacattattg

SEQ ID NO: 70864 - DNA, 18 bp, synthetic construct
  source 1..18: mol_type = other DNA
tagtgagactcacaaaag

SEQ ID NO: 70865 - DNA, 18 bp, synthetic construct
  source 1..18: mol_type = other DNA
tagttcgaaacattaaag

SEQ ID NO: 70866 - DNA, 18 bp, synthetic construct
  source 1..18: mol_type = other DNA
tataacaacacccaattg

SEQ ID NO: 70867 - DNA, 18 bp, synthetic construct
  source 1..18: mol_type = other DNA
tataacaactcactcttg

SEQ ID NO: 70868 - DNA, 18 bp, synthetic construct
  source 1..18: mol_type = other DNA
tataacgacccattattg

SEQ ID NO: 70869 - DNA, 18 bp, synthetic construct
  source 1..18: mol_type = other DNA
tataacgactctttatcg

SEQ ID NO: 70870 - DNA, 18 bp, synthetic construct
  source 1..18: mol_type = other DNA
tataacgactggctattg

SEQ ID NO: 70871 - DNA, 18 bp, synthetic construct
  source 1..18: mol_type = other DNA
tataacgtctaaataatg

SEQ ID NO: 70872 - DNA, 18 bp, synthetic construct
  source 1..18: mol_type = other DNA
tataatgacacactaaag

SEQ ID NO: 70873 - DNA, 18 bp, synthetic construct
  source 1..18: mol_type = other DNA
tataatgattcacaatag

SEQ ID NO: 70874 - DNA, 18 bp, synthetic construct
  source 1..18: mol_type = other DNA
tatatctacccactatag

SEQ ID NO: 70875 - DNA, 18 bp, synthetic construct
  source 1..18: mol_type = other DNA
tatattgaatcactatag

SEQ ID NO: 70876 - DNA, 18 bp, synthetic construct
  source 1..18: mol_type = other DNA
tatcaggactcacaatgg

SEQ ID NO: 70877 - DNA, 18 bp, synthetic construct
  source 1..18: mol_type = other DNA
tatcaggccaaactatag

SEQ ID NO: 70878 - DNA, 18 bp, synthetic construct
  source 1..18: mol_type = other DNA
tatcccaactcactttag

SEQ ID NO: 70879 - DNA, 18 bp, synthetic construct
  source 1..18: mol_type = other DNA
tatcgcgattcagtattg

SEQ ID NO: 70880 - DNA, 18 bp, synthetic construct
  source 1..18: mol_type = other DNA
tatcgtgatttaccatag

SEQ ID NO: 70881 - DNA, 18 bp, synthetic construct
  source 1..18: mol_type = other DNA
tatctcgactctcaactg

SEQ ID NO: 70882 - DNA, 18 bp, synthetic construct
  source 1..18: mol_type = other DNA
tatgacgtcttgctatag

SEQ ID NO: 70883 - DNA, 18 bp, synthetic construct
  source 1..18: mol_type = other DNA
tattaacactcaatattg

SEQ ID NO: 70884 - DNA, 18 bp, synthetic construct
  source 1..18: mol_type = other DNA
tattaagtcaccctatag

SEQ ID NO: 70885 - DNA, 18 bp, synthetic construct
  source 1..18: mol_type = other DNA
tattaagtctaacaatag

SEQ ID NO: 70886 - DNA, 18 bp, synthetic construct
  source 1..18: mol_type = other DNA
tattaatagtacctatag

SEQ ID NO: 70887 - DNA, 18 bp, synthetic construct
  source 1..18: mol_type = other DNA
tattaccacccacgatcg

SEQ ID NO: 70888 - DNA, 18 bp, synthetic construct
  source 1..18: mol_type = other DNA
tattaccactaaccatcg

SEQ ID NO: 70889 - DNA, 18 bp, synthetic construct
  source 1..18: mol_type = other DNA
tattacgaatcttgattg

SEQ ID NO: 70890 - DNA, 18 bp, synthetic construct
  source 1..18: mol_type = other DNA
tattacgaatttatatag

SEQ ID NO: 70891 - DNA, 18 bp, synthetic construct
  source 1..18: mol_type = other DNA
tattacgaccaactaatg

SEQ ID NO: 70892 - DNA, 18 bp, synthetic construct
  source 1..18: mol_type = other DNA
tattacgactatttatgg

SEQ ID NO: 70893 - DNA, 18 bp, synthetic construct
  source 1..18: mol_type = other DNA
tattacgactctcttatg

SEQ ID NO: 70894 - DNA, 18 bp, synthetic construct
  source 1..18: mol_type = other DNA
tattacggcacataaaag

SEQ ID NO: 70895 - DNA, 18 bp, synthetic construct
  source 1..18: mol_type = other DNA
tattacgtctctcaaaag

SEQ ID NO: 70896 - DNA, 18 bp, synthetic construct
  source 1..18: mol_type = other DNA
tattactaccctccatag

SEQ ID NO: 70897 - DNA, 18 bp, synthetic construct
  source 1..18: mol_type = other DNA
tattactactcttctttg

SEQ ID NO: 70898 - DNA, 18 bp, synthetic construct
  source 1..18: mol_type = other DNA
tattactccactcaaaag

SEQ ID NO: 70899 - DNA, 18 bp, synthetic construct
  source 1..18: mol_type = other DNA
tattaggaccctctttag

SEQ ID NO: 70900 - DNA, 18 bp, synthetic construct
  source 1..18: mol_type = other DNA
tattaggactctccattg

SEQ ID NO: 70901 - DNA, 18 bp, synthetic construct
  source 1..18: mol_type = other DNA
tattatcacacattatag

SEQ ID NO: 70902 - DNA, 18 bp, synthetic construct
  source 1..18: mol_type = other DNA
tattatgactctctaacg

SEQ ID NO: 70903 - DNA, 18 bp, synthetic construct
  source 1..18: mol_type = other DNA
tattccgaaataccatag

SEQ ID NO: 70904 - DNA, 18 bp, synthetic construct
  source 1..18: mol_type = other DNA
tattccgactcattaatg

SEQ ID NO: 70905 - DNA, 18 bp, synthetic construct
  source 1..18: mol_type = other DNA
tattccttctcaatatag

SEQ ID NO: 70906 - DNA, 18 bp, synthetic construct
  source 1..18: mol_type = other DNA
tattctgactcgagatcg

SEQ ID NO: 70907 - DNA, 18 bp, synthetic construct
  source 1..18: mol_type = other DNA
tattctgattcataatag

SEQ ID NO: 70908 - DNA, 18 bp, synthetic construct
  source 1..18: mol_type = other DNA
tattgcctctgacgatag

SEQ ID NO: 70909 - DNA, 18 bp, synthetic construct
  source 1..18: mol_type = other DNA
tattgcgactctctcaag

SEQ ID NO: 70910 - DNA, 18 bp, synthetic construct
  source 1..18: mol_type = other DNA
tatttcagttcaccaatg

SEQ ID NO: 70911 - DNA, 18 bp, synthetic construct
  source 1..18: mol_type = other DNA
tatttcctctcactattg

SEQ ID NO: 70912 - DNA, 18 bp, synthetic construct
  source 1..18: mol_type = other DNA
tatttcctcttacaatag

SEQ ID NO: 70913 - DNA, 18 bp, synthetic construct
  source 1..18: mol_type = other DNA
tatttcgaatctatatag

SEQ ID NO: 70914 - DNA, 18 bp, synthetic construct
  source 1..18: mol_type = other DNA
tatttcgaatctgtattg

SEQ ID NO: 70915 - DNA, 18 bp, synthetic construct
  source 1..18: mol_type = other DNA
tatttcgacacacattag

SEQ ID NO: 70916 - DNA, 18 bp, synthetic construct
  source 1..18: mol_type = other DNA
tatttcgacgtactaaag

SEQ ID NO: 70917 - DNA, 18 bp, synthetic construct
  source 1..18: mol_type = other DNA
tatttcgactttctatgg

SEQ ID NO: 70918 - DNA, 18 bp, synthetic construct
  source 1..18: mol_type = other DNA
tatttcgccttacttttg

SEQ ID NO: 70919 - DNA, 18 bp, synthetic construct
  source 1..18: mol_type = other DNA
tatttcgtctcaaaatag

SEQ ID NO: 70920 - DNA, 18 bp, synthetic construct
  source 1..18: mol_type = other DNA
tatttggactcacatcag

SEQ ID NO: 70921 - DNA, 18 bp, synthetic construct
  source 1..18: mol_type = other DNA
tcaaaatacttactatag

SEQ ID NO: 70922 - DNA, 18 bp, synthetic construct
  source 1..18: mol_type = other DNA
tcaagtgacaaactatag

SEQ ID NO: 70923 - DNA, 18 bp, synthetic construct
  source 1..18: mol_type = other DNA
tcatacagatcaccaaag

SEQ ID NO: 70924 - DNA, 18 bp, synthetic construct
  source 1..18: mol_type = other DNA
tcataccgctctcatttg

SEQ ID NO: 70925 - DNA, 18 bp, synthetic construct
  source 1..18: mol_type = other DNA
tcatacgacaccacatag

SEQ ID NO: 70926 - DNA, 18 bp, synthetic construct
  source 1..18: mol_type = other DNA
tcatacgattcacttggg

SEQ ID NO: 70927 - DNA, 18 bp, synthetic construct
  source 1..18: mol_type = other DNA
tcatacgattcgtcaaag

SEQ ID NO: 70928 - DNA, 18 bp, synthetic construct
  source 1..18: mol_type = other DNA
tcatacgtatgactattg

SEQ ID NO: 70929 - DNA, 18 bp, synthetic construct
  source 1..18: mol_type = other DNA
tcatacgtctggctactg

SEQ ID NO: 70930 - DNA, 18 bp, synthetic construct
  source 1..18: mol_type = other DNA
tcatacttaatactatag

SEQ ID NO: 70931 - DNA, 18 bp, synthetic construct
  source 1..18: mol_type = other DNA
tcataggcctatctttag

SEQ ID NO: 70932 - DNA, 18 bp, synthetic construct
  source 1..18: mol_type = other DNA
tcatgcgactctcaattg

SEQ ID NO: 70933 - DNA, 18 bp, synthetic construct
  source 1..18: mol_type = other DNA
tcattcgtttcactctag

SEQ ID NO: 70934 - DNA, 18 bp, synthetic construct
  source 1..18: mol_type = other DNA
tccacctactcactatag

SEQ ID NO: 70935 - DNA, 18 bp, synthetic construct
  source 1..18: mol_type = other DNA
tcctacatctcacaaaag

SEQ ID NO: 70936 - DNA, 18 bp, synthetic construct
  source 1..18: mol_type = other DNA
tcgtaccccgtacaatcg

SEQ ID NO: 70937 - DNA, 18 bp, synthetic construct
  source 1..18: mol_type = other DNA
tcgttcgtctttctaaag

SEQ ID NO: 70938 - DNA, 18 bp, synthetic construct
  source 1..18: mol_type = other DNA
tcttacaactcacttttg

SEQ ID NO: 70939 - DNA, 18 bp, synthetic construct
  source 1..18: mol_type = other DNA
tcttacgaatcacttaag

SEQ ID NO: 70940 - DNA, 18 bp, synthetic construct
  source 1..18: mol_type = other DNA
tgaaatgactcacttttg

SEQ ID NO: 70941 - DNA, 18 bp, synthetic construct
  source 1..18: mol_type = other DNA
tgataagaatctctgttg

SEQ ID NO: 70942 - DNA, 18 bp, synthetic construct
  source 1..18: mol_type = other DNA
tgataagagtcaatagag

SEQ ID NO: 70943 - DNA, 18 bp, synthetic construct
  source 1..18: mol_type = other DNA
tgatacgacattctttag

SEQ ID NO: 70944 - DNA, 18 bp, synthetic construct
  source 1..18: mol_type = other DNA
tgatacgtatcactttcg

SEQ ID NO: 70945 - DNA, 18 bp, synthetic construct
  source 1..18: mol_type = other DNA
tgatacgtccctctatgg

SEQ ID NO: 70946 - DNA, 18 bp, synthetic construct
  source 1..18: mol_type = other DNA
tgatactactatctatcg

SEQ ID NO: 70947 - DNA, 18 bp, synthetic construct
  source 1..18: mol_type = other DNA
tgatatggctttctatag

SEQ ID NO: 70948 - DNA, 18 bp, synthetic construct
  source 1..18: mol_type = other DNA
tgatcagatacactatag

SEQ ID NO: 70949 - DNA, 18 bp, synthetic construct
  source 1..18: mol_type = other DNA
tgatccgtctcaatagag

SEQ ID NO: 70950 - DNA, 18 bp, synthetic construct
  source 1..18: mol_type = other DNA
tgattccactaacgattg

SEQ ID NO: 70951 - DNA, 18 bp, synthetic construct
  source 1..18: mol_type = other DNA
tgattcggatgtttaaag

SEQ ID NO: 70952 - DNA, 18 bp, synthetic construct
  source 1..18: mol_type = other DNA
tgattcgtctcatcatag

SEQ ID NO: 70953 - DNA, 18 bp, synthetic construct
  source 1..18: mol_type = other DNA
tgatttgtctctctatag

SEQ ID NO: 70954 - DNA, 18 bp, synthetic construct
  source 1..18: mol_type = other DNA
tgctacctctcactattg

SEQ ID NO: 70955 - DNA, 18 bp, synthetic construct
  source 1..18: mol_type = other DNA
tgctcctactcactttag

SEQ ID NO: 70956 - DNA, 18 bp, synthetic construct
  source 1..18: mol_type = other DNA
tgtaacgacacgctatag

SEQ ID NO: 70957 - DNA, 18 bp, synthetic construct
  source 1..18: mol_type = other DNA
tgttacatatcaccatag

SEQ ID NO: 70958 - DNA, 18 bp, synthetic construct
  source 1..18: mol_type = other DNA
tgttaccaccaactatag

SEQ ID NO: 70959 - DNA, 18 bp, synthetic construct
  source 1..18: mol_type = other DNA
tgttagaacacaaaatag

SEQ ID NO: 70960 - DNA, 18 bp, synthetic construct
  source 1..18: mol_type = other DNA
tgttatatcttacatcag

SEQ ID NO: 70961 - DNA, 18 bp, synthetic construct
  source 1..18: mol_type = other DNA
ttaaaagactcacttttg

SEQ ID NO: 70962 - DNA, 18 bp, synthetic construct
  source 1..18: mol_type = other DNA
ttaaaccgctcactaaag

SEQ ID NO: 70963 - DNA, 18 bp, synthetic construct
  source 1..18: mol_type = other DNA
ttaaacctctaccaatag

SEQ ID NO: 70964 - DNA, 18 bp, synthetic construct
  source 1..18: mol_type = other DNA
ttaaacgaatctattttg

SEQ ID NO: 70965 - DNA, 18 bp, synthetic construct
  source 1..18: mol_type = other DNA
ttaaacgacacacatggg

SEQ ID NO: 70966 - DNA, 18 bp, synthetic construct
  source 1..18: mol_type = other DNA
ttaaacgactatctaaag

SEQ ID NO: 70967 - DNA, 18 bp, synthetic construct
  source 1..18: mol_type = other DNA
ttaaacttctcactctag

SEQ ID NO: 70968 - DNA, 18 bp, synthetic construct
  source 1..18: mol_type = other DNA
ttaaaggatgcactatag

SEQ ID NO: 70969 - DNA, 18 bp, synthetic construct
  source 1..18: mol_type = other DNA
ttaaatgtctcaatctag

SEQ ID NO: 70970 - DNA, 18 bp, synthetic construct
  source 1..18: mol_type = other DNA
ttaaccgcctcactaaag

SEQ ID NO: 70971 - DNA, 18 bp, synthetic construct
  source 1..18: mol_type = other DNA
ttaatagacactatatag

SEQ ID NO: 70972 - DNA, 18 bp, synthetic construct
  source 1..18: mol_type = other DNA
ttaatcgaaacactattg

SEQ ID NO: 70973 - DNA, 18 bp, synthetic construct
  source 1..18: mol_type = other DNA
ttaatcgattcgctatag

SEQ ID NO: 70974 - DNA, 18 bp, synthetic construct
  source 1..18: mol_type = other DNA
ttacacctttcactacag

SEQ ID NO: 70975 - DNA, 18 bp, synthetic construct
  source 1..18: mol_type = other DNA
ttacacgaaacagttgag

SEQ ID NO: 70976 - DNA, 18 bp, synthetic construct
  source 1..18: mol_type = other DNA
ttacacgacacgctctag

SEQ ID NO: 70977 - DNA, 18 bp, synthetic construct
  source 1..18: mol_type = other DNA
ttacacgaccctctagag

SEQ ID NO: 70978 - DNA, 18 bp, synthetic construct
  source 1..18: mol_type = other DNA
ttacacgtctcactgagg

SEQ ID NO: 70979 - DNA, 18 bp, synthetic construct
  source 1..18: mol_type = other DNA
ttacatgtctctctatag

SEQ ID NO: 70980 - DNA, 18 bp, synthetic construct
  source 1..18: mol_type = other DNA
ttaccatactatctatag

SEQ ID NO: 70981 - DNA, 18 bp, synthetic construct
  source 1..18: mol_type = other DNA
ttactcgcctcacttaag

SEQ ID NO: 70982 - DNA, 18 bp, synthetic construct
  source 1..18: mol_type = other DNA
ttacttcactcacaattg

SEQ ID NO: 70983 - DNA, 18 bp, synthetic construct
  source 1..18: mol_type = other DNA
ttacttgactcactatgg

SEQ ID NO: 70984 - DNA, 18 bp, synthetic construct
  source 1..18: mol_type = other DNA
ttagacctccccctagtg

SEQ ID NO: 70985 - DNA, 18 bp, synthetic construct
  source 1..18: mol_type = other DNA
ttagacgacgctccatag

SEQ ID NO: 70986 - DNA, 18 bp, synthetic construct
  source 1..18: mol_type = other DNA
ttagacgattaactattg

SEQ ID NO: 70987 - DNA, 18 bp, synthetic construct
  source 1..18: mol_type = other DNA
ttagataactaactcaag

SEQ ID NO: 70988 - DNA, 18 bp, synthetic construct
  source 1..18: mol_type = other DNA
ttataaacctctcaatag

SEQ ID NO: 70989 - DNA, 18 bp, synthetic construct
  source 1..18: mol_type = other DNA
ttataagactcgcgttag

SEQ ID NO: 70990 - DNA, 18 bp, synthetic construct
  source 1..18: mol_type = other DNA
ttataaggctcaatgtgg

SEQ ID NO: 70991 - DNA, 18 bp, synthetic construct
  source 1..18: mol_type = other DNA
ttataattcgcgtgatag

SEQ ID NO: 70992 - DNA, 18 bp, synthetic construct
  source 1..18: mol_type = other DNA
ttatacaactcacaaatg

SEQ ID NO: 70993 - DNA, 18 bp, synthetic construct
  source 1..18: mol_type = other DNA
ttatacaactcatgctag

SEQ ID NO: 70994 - DNA, 18 bp, synthetic construct
  source 1..18: mol_type = other DNA
ttatacatctatctatag

SEQ ID NO: 70995 - DNA, 18 bp, synthetic construct
  source 1..18: mol_type = other DNA
ttatacatctcattaatg

SEQ ID NO: 70996 - DNA, 18 bp, synthetic construct
  source 1..18: mol_type = other DNA
ttataccactctttacag

SEQ ID NO: 70997 - DNA, 18 bp, synthetic construct
  source 1..18: mol_type = other DNA
ttataccacttacaattg

SEQ ID NO: 70998 - DNA, 18 bp, synthetic construct
  source 1..18: mol_type = other DNA
ttatacgaaacacaatcg

SEQ ID NO: 70999 - DNA, 18 bp, synthetic construct
  source 1..18: mol_type = other DNA
ttatacgactctattgtg

SEQ ID NO: 71000 - DNA, 18 bp, synthetic construct
  source 1..18: mol_type = other DNA
ttatacgactcttaatgg

SEQ ID NO: 71001 - DNA, 18 bp, synthetic construct
  source 1..18: mol_type = other DNA
ttatacgactggcttaag

SEQ ID NO: 71002 - DNA, 18 bp, synthetic construct
  source 1..18: mol_type = other DNA
ttatacgatcatctgaag

SEQ ID NO: 71003 - DNA, 18 bp, synthetic construct
  source 1..18: mol_type = other DNA
ttatacgattaacgagcg

SEQ ID NO: 71004 - DNA, 18 bp, synthetic construct
  source 1..18: mol_type = other DNA
ttatacgattaactaagg

SEQ ID NO: 71005 - DNA, 18 bp, synthetic construct
  source 1..18: mol_type = other DNA
ttatacgatttaccatgg

SEQ ID NO: 71006 - DNA, 18 bp, synthetic construct
  source 1..18: mol_type = other DNA
ttatacggatgacaatag

SEQ ID NO: 71007 - DNA, 18 bp, synthetic construct
  source 1..18: mol_type = other DNA
ttatacggttcactaatg

SEQ ID NO: 71008 - DNA, 18 bp, synthetic construct
  source 1..18: mol_type = other DNA
ttatactaatctcctttg

SEQ ID NO: 71009 - DNA, 18 bp, synthetic construct
  source 1..18: mol_type = other DNA
ttatactacaatctatag

SEQ ID NO: 71010 - DNA, 18 bp, synthetic construct
  source 1..18: mol_type = other DNA
ttatactactcgatagag

SEQ ID NO: 71011 - DNA, 18 bp, synthetic construct
  source 1..18: mol_type = other DNA
ttatactcctcacattag

SEQ ID NO: 71012 - DNA, 18 bp, synthetic construct
  source 1..18: mol_type = other DNA
ttatactttcctatatag

SEQ ID NO: 71013 - DNA, 18 bp, synthetic construct
  source 1..18: mol_type = other DNA
ttatagaactctctacag

SEQ ID NO: 71014 - DNA, 18 bp, synthetic construct
  source 1..18: mol_type = other DNA
ttataggaccttctatag

SEQ ID NO: 71015 - DNA, 18 bp, synthetic construct
  source 1..18: mol_type = other DNA
ttatatatcccactatag

SEQ ID NO: 71016 - DNA, 18 bp, synthetic construct
  source 1..18: mol_type = other DNA
ttatatcgctcacagtag

SEQ ID NO: 71017 - DNA, 18 bp, synthetic construct
  source 1..18: mol_type = other DNA
ttatatgattcacatcag

SEQ ID NO: 71018 - DNA, 18 bp, synthetic construct
  source 1..18: mol_type = other DNA
ttatatgtctcactagcg

SEQ ID NO: 71019 - DNA, 18 bp, synthetic construct
  source 1..18: mol_type = other DNA
ttatattattcacaatcg

SEQ ID NO: 71020 - DNA, 18 bp, synthetic construct
  source 1..18: mol_type = other DNA
ttatcccacttaacatag

SEQ ID NO: 71021 - DNA, 18 bp, synthetic construct
  source 1..18: mol_type = other DNA
ttatccgaaacaccatgg

SEQ ID NO: 71022 - DNA, 18 bp, synthetic construct
  source 1..18: mol_type = other DNA
ttatccgacccattttag

SEQ ID NO: 71023 - DNA, 18 bp, synthetic construct
  source 1..18: mol_type = other DNA
ttatccgagatacaatag

SEQ ID NO: 71024 - DNA, 18 bp, synthetic construct
  source 1..18: mol_type = other DNA
ttatccgtcgcagtattg

SEQ ID NO: 71025 - DNA, 18 bp, synthetic construct
  source 1..18: mol_type = other DNA
ttatcctactccctcttg

SEQ ID NO: 71026 - DNA, 18 bp, synthetic construct
  source 1..18: mol_type = other DNA
ttatctgactcactaatg

SEQ ID NO: 71027 - DNA, 18 bp, synthetic construct
  source 1..18: mol_type = other DNA
ttatgagcctcactaaag

SEQ ID NO: 71028 - DNA, 18 bp, synthetic construct
  source 1..18: mol_type = other DNA
ttatgaggctcattatag

SEQ ID NO: 71029 - DNA, 18 bp, synthetic construct
  source 1..18: mol_type = other DNA
ttatgccaatctccatag

SEQ ID NO: 71030 - DNA, 18 bp, synthetic construct
  source 1..18: mol_type = other DNA
ttatgcgactctcattag

SEQ ID NO: 71031 - DNA, 18 bp, synthetic construct
  source 1..18: mol_type = other DNA
ttattagacaccctatag

SEQ ID NO: 71032 - DNA, 18 bp, synthetic construct
  source 1..18: mol_type = other DNA
ttattcatctcactatcg

SEQ ID NO: 71033 - DNA, 18 bp, synthetic construct
  source 1..18: mol_type = other DNA
ttattccaccgactatag

SEQ ID NO: 71034 - DNA, 18 bp, synthetic construct
  source 1..18: mol_type = other DNA
ttattcctctcactttag

SEQ ID NO: 71035 - DNA, 18 bp, synthetic construct
  source 1..18: mol_type = other DNA
ttattcgacacacttaag

SEQ ID NO: 71036 - DNA, 18 bp, synthetic construct
  source 1..18: mol_type = other DNA
ttattcgacactttttag

SEQ ID NO: 71037 - DNA, 18 bp, synthetic construct
  source 1..18: mol_type = other DNA
ttattcgatacacattcg

SEQ ID NO: 71038 - DNA, 18 bp, synthetic construct
  source 1..18: mol_type = other DNA
ttattcgattcgcaaaag

SEQ ID NO: 71039 - DNA, 18 bp, synthetic construct
  source 1..18: mol_type = other DNA
ttattcgcctaaccattg

SEQ ID NO: 71040 - DNA, 18 bp, synthetic construct
  source 1..18: mol_type = other DNA
ttattcggcttacttaag

SEQ ID NO: 71041 - DNA, 18 bp, synthetic construct
  source 1..18: mol_type = other DNA
ttattcttatctctatag

SEQ ID NO: 71042 - DNA, 18 bp, synthetic construct
  source 1..18: mol_type = other DNA
ttcatcgactcactattg

SEQ ID NO: 71043 - DNA, 18 bp, synthetic construct
  source 1..18: mol_type = other DNA
ttctacgactctcttttg

SEQ ID NO: 71044 - DNA, 18 bp, synthetic construct
  source 1..18: mol_type = other DNA
ttctactaatctctatag

SEQ ID NO: 71045 - DNA, 18 bp, synthetic construct
  source 1..18: mol_type = other DNA
ttgcctgccactcttgag

SEQ ID NO: 71046 - DNA, 18 bp, synthetic construct
  source 1..18: mol_type = other DNA
ttgtaagatacactatag

SEQ ID NO: 71047 - DNA, 18 bp, synthetic construct
  source 1..18: mol_type = other DNA
ttgtacttcccactattg

SEQ ID NO: 71048 - DNA, 18 bp, synthetic construct
  source 1..18: mol_type = other DNA
ttgtccgattcataatag

SEQ ID NO: 71049 - DNA, 18 bp, synthetic construct
  source 1..18: mol_type = other DNA
ttgtgccattcactaaag

SEQ ID NO: 71050 - DNA, 18 bp, synthetic construct
  source 1..18: mol_type = other DNA
tttaacgagtgtatatag

SEQ ID NO: 71051 - DNA, 18 bp, synthetic construct
  source 1..18: mol_type = other DNA
ttttaagacacactaaag

SEQ ID NO: 71052 - DNA, 18 bp, synthetic construct
  source 1..18: mol_type = other DNA
ttttaagacacactcagg

SEQ ID NO: 71053 - DNA, 18 bp, synthetic construct
  source 1..18: mol_type = other DNA
ttttacatatcaccattg

SEQ ID NO: 71054 - DNA, 18 bp, synthetic construct
  source 1..18: mol_type = other DNA
ttttacgacactctaaag

SEQ ID NO: 71055 - DNA, 18 bp, synthetic construct
  source 1..18: mol_type = other DNA
ttttacgacagtctacgg

SEQ ID NO: 71056 - DNA, 18 bp, synthetic construct
  source 1..18: mol_type = other DNA
ttttacgcacccctaaag

SEQ ID NO: 71057 - DNA, 18 bp, synthetic construct
  source 1..18: mol_type = other DNA
ttttacgtctcacaaaag

SEQ ID NO: 71058 - DNA, 18 bp, synthetic construct
  source 1..18: mol_type = other DNA
ttttacgtctcactactg

SEQ ID NO: 71059 - DNA, 18 bp, synthetic construct
  source 1..18: mol_type = other DNA
ttttacgtctctctttag

SEQ ID NO: 71060 - DNA, 18 bp, synthetic construct
  source 1..18: mol_type = other DNA
ttttactactctttatag

SEQ ID NO: 71061 - DNA, 18 bp, synthetic construct
  source 1..18: mol_type = other DNA
ttttgcggctcaccatag

SEQ ID NO: 71062 - DNA, 18 bp, synthetic construct
  source 1..18: mol_type = other DNA
tttttcgactaactttag

SEQ ID NO: 71063 - DNA, 18 bp, synthetic construct
  source 1..18: mol_type = other DNA
aaaaacgactcacttatg

SEQ ID NO: 71064 - DNA, 18 bp, synthetic construct
  source 1..18: mol_type = other DNA
aattataactcactttag

SEQ ID NO: 71065 - DNA, 18 bp, synthetic construct
  source 1..18: mol_type = other DNA
taatatgacactctaatg

SEQ ID NO: 71066 - DNA, 18 bp, synthetic construct
  source 1..18: mol_type = other DNA
tattactacaagctatag

SEQ ID NO: 71067 - DNA, 18 bp, synthetic construct
  source 1..18: mol_type = other DNA
tatttcatctcactttag

SEQ ID NO: 71068 - DNA, 18 bp, synthetic construct
  source 1..18: mol_type = other DNA
ttaatcgactctcaatag

SEQ ID NO: 71069 - DNA, 18 bp, synthetic construct
  source 1..18: mol_type = other DNA
ttataagacacactaatg

SEQ ID NO: 71070 - DNA, 18 bp, synthetic construct
  source 1..18: mol_type = other DNA
ttatgcgattcacttttg

SEQ ID NO: 71071 - DNA, 18 bp, synthetic construct
  source 1..18: mol_type = other DNA
ttattagtcacactatag

SEQ ID NO: 71072 - DNA, 18 bp, synthetic construct
  source 1..18: mol_type = other DNA
ttttacgactcacatttg

SEQ ID NO: 71073 - DNA, 18 bp, synthetic construct
  source 1..18: mol_type = other DNA
tagtacgtatcaccaagg

SEQ ID NO: 71074 - DNA, 18 bp, synthetic construct
  source 1..18: mol_type = other DNA
ataatcgtctcactatag

SEQ ID NO: 71075 - DNA, 18 bp, synthetic construct
  source 1..18: mol_type = other DNA
atatacgactctcaaaag

SEQ ID NO: 71076 - DNA, 18 bp, synthetic construct
  source 1..18: mol_type = other DNA
taaaacgacacactcatg

SEQ ID NO: 71077 - DNA, 18 bp, synthetic construct
  source 1..18: mol_type = other DNA
tagaacttcttactatag

SEQ ID NO: 71078 - DNA, 18 bp, synthetic construct
  source 1..18: mol_type = other DNA
tagtacgacttacttatg

SEQ ID NO: 71079 - DNA, 18 bp, synthetic construct
  source 1..18: mol_type = other DNA
tataattactcactttag

SEQ ID NO: 71080 - DNA, 18 bp, synthetic construct
  source 1..18: mol_type = other DNA
ttatacgtatctgtatag

SEQ ID NO: 71081 - DNA, 18 bp, synthetic construct
  source 1..18: mol_type = other DNA
ttatacttctctatatag

SEQ ID NO: 71082 - DNA, 18 bp, synthetic construct
  source 1..18: mol_type = other DNA
ttattcgactctcttaag

SEQ ID NO: 71083 - DNA, 18 bp, synthetic construct
  source 1..18: mol_type = other DNA
aaaatcatcattcactag

SEQ ID NO: 71084 - DNA, 18 bp, synthetic construct
  source 1..18: mol_type = other DNA
aaacacgattgactttag

SEQ ID NO: 71085 - DNA, 18 bp, synthetic construct
  source 1..18: mol_type = other DNA
aaacatgactcagtgttg

SEQ ID NO: 71086 - DNA, 18 bp, synthetic construct
  source 1..18: mol_type = other DNA
aaagacgacaccctattg

SEQ ID NO: 71087 - DNA, 18 bp, synthetic construct
  source 1..18: mol_type = other DNA
aaataactccatctatag

SEQ ID NO: 71088 - DNA, 18 bp, synthetic construct
  source 1..18: mol_type = other DNA
aaataagactcgtaatag

SEQ ID NO: 71089 - DNA, 18 bp, synthetic construct
  source 1..18: mol_type = other DNA
aaatacaactctctactg

SEQ ID NO: 71090 - DNA, 18 bp, synthetic construct
  source 1..18: mol_type = other DNA
aaatacaattcattttag

SEQ ID NO: 71091 - DNA, 18 bp, synthetic construct
  source 1..18: mol_type = other DNA
aaatacatcacattatag

SEQ ID NO: 71092 - DNA, 18 bp, synthetic construct
  source 1..18: mol_type = other DNA
aaatacatctcaagatag

SEQ ID NO: 71093 - DNA, 18 bp, synthetic construct
  source 1..18: mol_type = other DNA
aaataccaatcgcgatag

SEQ ID NO: 71094 - DNA, 18 bp, synthetic construct
  source 1..18: mol_type = other DNA
aaatacgactttcttgag

SEQ ID NO: 71095 - DNA, 18 bp, synthetic construct
  source 1..18: mol_type = other DNA
aaatacgagtcccaaagg

SEQ ID NO: 71096 - DNA, 18 bp, synthetic construct
  source 1..18: mol_type = other DNA
aaatacggctcacactcg

SEQ ID NO: 71097 - DNA, 18 bp, synthetic construct
  source 1..18: mol_type = other DNA
aaatacgtaatactatag

SEQ ID NO: 71098 - DNA, 18 bp, synthetic construct
  source 1..18: mol_type = other DNA
aaatacgtcccacaattg

SEQ ID NO: 71099 - DNA, 18 bp, synthetic construct
  source 1..18: mol_type = other DNA
aaatacttctaactaaag

SEQ ID NO: 71100 - DNA, 18 bp, synthetic construct
  source 1..18: mol_type = other DNA
aaatacttctcaatattg

SEQ ID NO: 71101 - DNA, 18 bp, synthetic construct
  source 1..18: mol_type = other DNA
aaatacttctgatcatag

SEQ ID NO: 71102 - DNA, 18 bp, synthetic construct
  source 1..18: mol_type = other DNA
aaatataactcactccag

SEQ ID NO: 71103 - DNA, 18 bp, synthetic construct
  source 1..18: mol_type = other DNA
aaatatgtatcacaatag

SEQ ID NO: 71104 - DNA, 18 bp, synthetic construct
  source 1..18: mol_type = other DNA
aaatctgcctcatcaatg

SEQ ID NO: 71105 - DNA, 18 bp, synthetic construct
  source 1..18: mol_type = other DNA
aaatgccacacacttaag

SEQ ID NO: 71106 - DNA, 18 bp, synthetic construct
  source 1..18: mol_type = other DNA
aaattcaaccctctattg

SEQ ID NO: 71107 - DNA, 18 bp, synthetic construct
  source 1..18: mol_type = other DNA
aaattgtactcatagtag

SEQ ID NO: 71108 - DNA, 18 bp, synthetic construct
  source 1..18: mol_type = other DNA
aacatctacacattctag

SEQ ID NO: 71109 - DNA, 18 bp, synthetic construct
  source 1..18: mol_type = other DNA
aaccacgtcacactatag

SEQ ID NO: 71110 - DNA, 18 bp, synthetic construct
  source 1..18: mol_type = other DNA
aactacgactcaccaatg

SEQ ID NO: 71111 - DNA, 18 bp, synthetic construct
  source 1..18: mol_type = other DNA
aactacgtatctcgatag

SEQ ID NO: 71112 - DNA, 18 bp, synthetic construct
  source 1..18: mol_type = other DNA
aagcacgactcagtctag

SEQ ID NO: 71113 - DNA, 18 bp, synthetic construct
  source 1..18: mol_type = other DNA
aataacaactcacgttag

SEQ ID NO: 71114 - DNA, 18 bp, synthetic construct
  source 1..18: mol_type = other DNA
aatatcgattcacgatag

SEQ ID NO: 71115 - DNA, 18 bp, synthetic construct
  source 1..18: mol_type = other DNA
aatcatgagtctctatag

SEQ ID NO: 71116 - DNA, 18 bp, synthetic construct
  source 1..18: mol_type = other DNA
aatgacgagacactattg

SEQ ID NO: 71117 - DNA, 18 bp, synthetic construct
  source 1..18: mol_type = other DNA
aattacgacacacttcag

SEQ ID NO: 71118 - DNA, 18 bp, synthetic construct
  source 1..18: mol_type = other DNA
aattacgattggcgaaag

SEQ ID NO: 71119 - DNA, 18 bp, synthetic construct
  source 1..18: mol_type = other DNA
aattacgatttactgaag

SEQ ID NO: 71120 - DNA, 18 bp, synthetic construct
  source 1..18: mol_type = other DNA
aattactattcactttag

SEQ ID NO: 71121 - DNA, 18 bp, synthetic construct
  source 1..18: mol_type = other DNA
aattactattgactatag

SEQ ID NO: 71122 - DNA, 18 bp, synthetic construct
  source 1..18: mol_type = other DNA
aattagtactcactaatg

SEQ ID NO: 71123 - DNA, 18 bp, synthetic construct
  source 1..18: mol_type = other DNA
aatttcgactcacaagag

SEQ ID NO: 71124 - DNA, 18 bp, synthetic construct
  source 1..18: mol_type = other DNA
aatttcgactctcaaaag

SEQ ID NO: 71125 - DNA, 18 bp, synthetic construct
  source 1..18: mol_type = other DNA
aatttcgacttactctcg

SEQ ID NO: 71126 - DNA, 18 bp, synthetic construct
  source 1..18: mol_type = other DNA
acacacaacttactaaag

SEQ ID NO: 71127 - DNA, 18 bp, synthetic construct
  source 1..18: mol_type = other DNA
acattcgctttactaatg

SEQ ID NO: 71128 - DNA, 18 bp, synthetic construct
  source 1..18: mol_type = other DNA
agatacttttcaccatag

SEQ ID NO: 71129 - DNA, 18 bp, synthetic construct
  source 1..18: mol_type = other DNA
agatataactcacttaag

SEQ ID NO: 71130 - DNA, 18 bp, synthetic construct
  source 1..18: mol_type = other DNA
ataaacaactaactatag

SEQ ID NO: 71131 - DNA, 18 bp, synthetic construct
  source 1..18: mol_type = other DNA
ataatctactcactatag

SEQ ID NO: 71132 - DNA, 18 bp, synthetic construct
  source 1..18: mol_type = other DNA
atagactactcacaatag

SEQ ID NO: 71133 - DNA, 18 bp, synthetic construct
  source 1..18: mol_type = other DNA
atataagactcaataaag

SEQ ID NO: 71134 - DNA, 18 bp, synthetic construct
  source 1..18: mol_type = other DNA
atatacaactcacttaag

SEQ ID NO: 71135 - DNA, 18 bp, synthetic construct
  source 1..18: mol_type = other DNA
atatacgaaccactatcg

SEQ ID NO: 71136 - DNA, 18 bp, synthetic construct
  source 1..18: mol_type = other DNA
atatacgacccactaatg

SEQ ID NO: 71137 - DNA, 18 bp, synthetic construct
  source 1..18: mol_type = other DNA
atatacgagtctataaag

SEQ ID NO: 71138 - DNA, 18 bp, synthetic construct
  source 1..18: mol_type = other DNA
atatacgtctcacaaaag

SEQ ID NO: 71139 - DNA, 18 bp, synthetic construct
  source 1..18: mol_type = other DNA
atatacgttttcctatag

SEQ ID NO: 71140 - DNA, 18 bp, synthetic construct
  source 1..18: mol_type = other DNA
atatactaatcactattg

SEQ ID NO: 71141 - DNA, 18 bp, synthetic construct
  source 1..18: mol_type = other DNA
atatatgccacactatgg

SEQ ID NO: 71142 - DNA, 18 bp, synthetic construct
  source 1..18: mol_type = other DNA
atatgccattctatactg

SEQ ID NO: 71143 - DNA, 18 bp, synthetic construct
  source 1..18: mol_type = other DNA
atatgcgactgattgatg

SEQ ID NO: 71144 - DNA, 18 bp, synthetic construct
  source 1..18: mol_type = other DNA
atattcaactgactatag

SEQ ID NO: 71145 - DNA, 18 bp, synthetic construct
  source 1..18: mol_type = other DNA
atattcgtatcactatag

SEQ ID NO: 71146 - DNA, 18 bp, synthetic construct
  source 1..18: mol_type = other DNA
attaacgtctgactatag

SEQ ID NO: 71147 - DNA, 18 bp, synthetic construct
  source 1..18: mol_type = other DNA
atttacgactcaccaaag

SEQ ID NO: 71148 - DNA, 18 bp, synthetic construct
  source 1..18: mol_type = other DNA
caaaacgcctcactaacg

SEQ ID NO: 71149 - DNA, 18 bp, synthetic construct
  source 1..18: mol_type = other DNA
caaaactttactcaatag

SEQ ID NO: 71150 - DNA, 18 bp, synthetic construct
  source 1..18: mol_type = other DNA
caataacaaaccctagag

SEQ ID NO: 71151 - DNA, 18 bp, synthetic construct
  source 1..18: mol_type = other DNA
caataagactcgccattg

SEQ ID NO: 71152 - DNA, 18 bp, synthetic construct
  source 1..18: mol_type = other DNA
caatacgacacaccgtgg

SEQ ID NO: 71153 - DNA, 18 bp, synthetic construct
  source 1..18: mol_type = other DNA
caattcgcctctctttag

SEQ ID NO: 71154 - DNA, 18 bp, synthetic construct
  source 1..18: mol_type = other DNA
caatttgtcacactatag

SEQ ID NO: 71155 - DNA, 18 bp, synthetic construct
  source 1..18: mol_type = other DNA
cacatcgaatcacaattg

SEQ ID NO: 71156 - DNA, 18 bp, synthetic construct
  source 1..18: mol_type = other DNA
caccaactttcactattg

SEQ ID NO: 71157 - DNA, 18 bp, synthetic construct
  source 1..18: mol_type = other DNA
caccacgagtcactaaag

SEQ ID NO: 71158 - DNA, 18 bp, synthetic construct
  source 1..18: mol_type = other DNA
catatcgactcactttag

SEQ ID NO: 71159 - DNA, 18 bp, synthetic construct
  source 1..18: mol_type = other DNA
cattaccacccacgatag

SEQ ID NO: 71160 - DNA, 18 bp, synthetic construct
  source 1..18: mol_type = other DNA
catttcaactcacgatag

SEQ ID NO: 71161 - DNA, 18 bp, synthetic construct
  source 1..18: mol_type = other DNA
cggcacgactcactttag

SEQ ID NO: 71162 - DNA, 18 bp, synthetic construct
  source 1..18: mol_type = other DNA
cgtaacgacttatcatag

SEQ ID NO: 71163 - DNA, 18 bp, synthetic construct
  source 1..18: mol_type = other DNA
cgtagccacacactatag

SEQ ID NO: 71164 - DNA, 18 bp, synthetic construct
  source 1..18: mol_type = other DNA
ctaaacgatttactactg

SEQ ID NO: 71165 - DNA, 18 bp, synthetic construct
  source 1..18: mol_type = other DNA
ctaaactactcactattg

SEQ ID NO: 71166 - DNA, 18 bp, synthetic construct
  source 1..18: mol_type = other DNA
ctacacgtctcactctag

SEQ ID NO: 71167 - DNA, 18 bp, synthetic construct
  source 1..18: mol_type = other DNA
ctatacgactccccacag

SEQ ID NO: 71168 - DNA, 18 bp, synthetic construct
  source 1..18: mol_type = other DNA
ctataggtctcacaatag

SEQ ID NO: 71169 - DNA, 18 bp, synthetic construct
  source 1..18: mol_type = other DNA
ctatatcactctctatag

SEQ ID NO: 71170 - DNA, 18 bp, synthetic construct
  source 1..18: mol_type = other DNA
ctatccgactctctttag

SEQ ID NO: 71171 - DNA, 18 bp, synthetic construct
  source 1..18: mol_type = other DNA
gaacacacctcattatag

SEQ ID NO: 71172 - DNA, 18 bp, synthetic construct
  source 1..18: mol_type = other DNA
gaatatgatacactatgg

SEQ ID NO: 71173 - DNA, 18 bp, synthetic construct
  source 1..18: mol_type = other DNA
gaatatgattcacttttg

SEQ ID NO: 71174 - DNA, 18 bp, synthetic construct
  source 1..18: mol_type = other DNA
gaattcgacagacttcag

SEQ ID NO: 71175 - DNA, 18 bp, synthetic construct
  source 1..18: mol_type = other DNA
gagtacgaaagacattag

SEQ ID NO: 71176 - DNA, 18 bp, synthetic construct
  source 1..18: mol_type = other DNA
gataacgacactctatag

SEQ ID NO: 71177 - DNA, 18 bp, synthetic construct
  source 1..18: mol_type = other DNA
gattaagactcgcaatag

SEQ ID NO: 71178 - DNA, 18 bp, synthetic construct
  source 1..18: mol_type = other DNA
gatttcaactcactttag

SEQ ID NO: 71179 - DNA, 18 bp, synthetic construct
  source 1..18: mol_type = other DNA
gtaaccgtcactctattg

SEQ ID NO: 71180 - DNA, 18 bp, synthetic construct
  source 1..18: mol_type = other DNA
gtatatgattcattaaag

SEQ ID NO: 71181 - DNA, 18 bp, synthetic construct
  source 1..18: mol_type = other DNA
taaaaagactcacatttg

SEQ ID NO: 71182 - DNA, 18 bp, synthetic construct
  source 1..18: mol_type = other DNA
taaaaatattcactattg

SEQ ID NO: 71183 - DNA, 18 bp, synthetic construct
  source 1..18: mol_type = other DNA
taaaacaacactctattg

SEQ ID NO: 71184 - DNA, 18 bp, synthetic construct
  source 1..18: mol_type = other DNA
taaaacgaatcatttttg

SEQ ID NO: 71185 - DNA, 18 bp, synthetic construct
  source 1..18: mol_type = other DNA
taaaacgacactacatag

SEQ ID NO: 71186 - DNA, 18 bp, synthetic construct
  source 1..18: mol_type = other DNA
taaaacgactcgctcatg

SEQ ID NO: 71187 - DNA, 18 bp, synthetic construct
  source 1..18: mol_type = other DNA
taaaacgagtcacaaatg

SEQ ID NO: 71188 - DNA, 18 bp, synthetic construct
  source 1..18: mol_type = other DNA
taaaacgattgacaaaag

SEQ ID NO: 71189 - DNA, 18 bp, synthetic construct
  source 1..18: mol_type = other DNA
taaaacgtatcaatgttg

SEQ ID NO: 71190 - DNA, 18 bp, synthetic construct
  source 1..18: mol_type = other DNA
taaaactacaatctattg

SEQ ID NO: 71191 - DNA, 18 bp, synthetic construct
  source 1..18: mol_type = other DNA
taaaactacacccaatag

SEQ ID NO: 71192 - DNA, 18 bp, synthetic construct
  source 1..18: mol_type = other DNA
taaaagcattctcactcg

SEQ ID NO: 71193 - DNA, 18 bp, synthetic construct
  source 1..18: mol_type = other DNA
taaaccgactatctttag

SEQ ID NO: 71194 - DNA, 18 bp, synthetic construct
  source 1..18: mol_type = other DNA
taaaccttctcactaaag

SEQ ID NO: 71195 - DNA, 18 bp, synthetic construct
  source 1..18: mol_type = other DNA
taaagcgtgtcactatgg

SEQ ID NO: 71196 - DNA, 18 bp, synthetic construct
  source 1..18: mol_type = other DNA
taaagctattcactaaag

SEQ ID NO: 71197 - DNA, 18 bp, synthetic construct
  source 1..18: mol_type = other DNA
taaatagtctcactaagg

SEQ ID NO: 71198 - DNA, 18 bp, synthetic construct
  source 1..18: mol_type = other DNA
taaatccactcacaaatg

SEQ ID NO: 71199 - DNA, 18 bp, synthetic construct
  source 1..18: mol_type = other DNA
taaatcgactcaaaacag

SEQ ID NO: 71200 - DNA, 18 bp, synthetic construct
  source 1..18: mol_type = other DNA
taaatcgatatattttag

SEQ ID NO: 71201 - DNA, 18 bp, synthetic construct
  source 1..18: mol_type = other DNA
taaatcgtcttactacag

SEQ ID NO: 71202 - DNA, 18 bp, synthetic construct
  source 1..18: mol_type = other DNA
taaatctacatactattg

SEQ ID NO: 71203 - DNA, 18 bp, synthetic construct
  source 1..18: mol_type = other DNA
taaattgactcacatttg

SEQ ID NO: 71204 - DNA, 18 bp, synthetic construct
  source 1..18: mol_type = other DNA
taacaactaccataatag

SEQ ID NO: 71205 - DNA, 18 bp, synthetic construct
  source 1..18: mol_type = other DNA
taacacgatacacttacg

SEQ ID NO: 71206 - DNA, 18 bp, synthetic construct
  source 1..18: mol_type = other DNA
taacacttctccctatcg

SEQ ID NO: 71207 - DNA, 18 bp, synthetic construct
  source 1..18: mol_type = other DNA
taacataccattctttag

SEQ ID NO: 71208 - DNA, 18 bp, synthetic construct
  source 1..18: mol_type = other DNA
taacatgaccttctatgg

SEQ ID NO: 71209 - DNA, 18 bp, synthetic construct
  source 1..18: mol_type = other DNA
taacatgtcatatcatag

SEQ ID NO: 71210 - DNA, 18 bp, synthetic construct
  source 1..18: mol_type = other DNA
taaccagacacatcatag

SEQ ID NO: 71211 - DNA, 18 bp, synthetic construct
  source 1..18: mol_type = other DNA
taactcgactgaacatcg

SEQ ID NO: 71212 - DNA, 18 bp, synthetic construct
  source 1..18: mol_type = other DNA
taactggtctgactctag

SEQ ID NO: 71213 - DNA, 18 bp, synthetic construct
  source 1..18: mol_type = other DNA
taagacaatactgtgtgg

SEQ ID NO: 71214 - DNA, 18 bp, synthetic construct
  source 1..18: mol_type = other DNA
taagataactcgctattg

SEQ ID NO: 71215 - DNA, 18 bp, synthetic construct
  source 1..18: mol_type = other DNA
taataagaatcattaatg

SEQ ID NO: 71216 - DNA, 18 bp, synthetic construct
  source 1..18: mol_type = other DNA
taataagacacatttcag

SEQ ID NO: 71217 - DNA, 18 bp, synthetic construct
  source 1..18: mol_type = other DNA
taataagtctcttttaag

SEQ ID NO: 71218 - DNA, 18 bp, synthetic construct
  source 1..18: mol_type = other DNA
taataagttttattagag

SEQ ID NO: 71219 - DNA, 18 bp, synthetic construct
  source 1..18: mol_type = other DNA
taatacaaccaaataaag

SEQ ID NO: 71220 - DNA, 18 bp, synthetic construct
  source 1..18: mol_type = other DNA
taatacaactcttaaaag

SEQ ID NO: 71221 - DNA, 18 bp, synthetic construct
  source 1..18: mol_type = other DNA
taatacaagtaactactg

SEQ ID NO: 71222 - DNA, 18 bp, synthetic construct
  source 1..18: mol_type = other DNA
taatacaccacacaatcg

SEQ ID NO: 71223 - DNA, 18 bp, synthetic construct
  source 1..18: mol_type = other DNA
taatacatcacacaaaag

SEQ ID NO: 71224 - DNA, 18 bp, synthetic construct
  source 1..18: mol_type = other DNA
taatacatcttacttttg

SEQ ID NO: 71225 - DNA, 18 bp, synthetic construct
  source 1..18: mol_type = other DNA
taataccattaattagag

SEQ ID NO: 71226 - DNA, 18 bp, synthetic construct
  source 1..18: mol_type = other DNA
taataccgctcattactg

SEQ ID NO: 71227 - DNA, 18 bp, synthetic construct
  source 1..18: mol_type = other DNA
taatacctctcaagctag

SEQ ID NO: 71228 - DNA, 18 bp, synthetic construct
  source 1..18: mol_type = other DNA
taatacgaaaaatttttg

SEQ ID NO: 71229 - DNA, 18 bp, synthetic construct
  source 1..18: mol_type = other DNA
taatacgaaaccctaggg

SEQ ID NO: 71230 - DNA, 18 bp, synthetic construct
  source 1..18: mol_type = other DNA
taatacgaaactttttag

SEQ ID NO: 71231 - DNA, 18 bp, synthetic construct
  source 1..18: mol_type = other DNA
taatacgaaatacgttag

SEQ ID NO: 71232 - DNA, 18 bp, synthetic construct
  source 1..18: mol_type = other DNA
taatacgaaatcctagag

SEQ ID NO: 71233 - DNA, 18 bp, synthetic construct
  source 1..18: mol_type = other DNA
taatacgaatcatattgg

SEQ ID NO: 71234 - DNA, 18 bp, synthetic construct
  source 1..18: mol_type = other DNA
taatacgacgtgcattag

SEQ ID NO: 71235 - DNA, 18 bp, synthetic construct
  source 1..18: mol_type = other DNA
taatacgagactccaagg

SEQ ID NO: 71236 - DNA, 18 bp, synthetic construct
  source 1..18: mol_type = other DNA
taatacgattcaacagtg

SEQ ID NO: 71237 - DNA, 18 bp, synthetic construct
  source 1..18: mol_type = other DNA
taatacgattcccacttg

SEQ ID NO: 71238 - DNA, 18 bp, synthetic construct
  source 1..18: mol_type = other DNA
taatacgtcatacaattg

SEQ ID NO: 71239 - DNA, 18 bp, synthetic construct
  source 1..18: mol_type = other DNA
taatacgtctatcaacag

SEQ ID NO: 71240 - DNA, 18 bp, synthetic construct
  source 1..18: mol_type = other DNA
taatacgtctatcaatcg

SEQ ID NO: 71241 - DNA, 18 bp, synthetic construct
  source 1..18: mol_type = other DNA
taatacgtctctcttatg

SEQ ID NO: 71242 - DNA, 18 bp, synthetic construct
  source 1..18: mol_type = other DNA
taatacgtctgctttaag

SEQ ID NO: 71243 - DNA, 18 bp, synthetic construct
  source 1..18: mol_type = other DNA
taatacgtgtccatattg

SEQ ID NO: 71244 - DNA, 18 bp, synthetic construct
  source 1..18: mol_type = other DNA
taatacgtttccctaatg

SEQ ID NO: 71245 - DNA, 18 bp, synthetic construct
  source 1..18: mol_type = other DNA
taatacgtttctccatgg

SEQ ID NO: 71246 - DNA, 18 bp, synthetic construct
  source 1..18: mol_type = other DNA
taatactacccgcaatcg

SEQ ID NO: 71247 - DNA, 18 bp, synthetic construct
  source 1..18: mol_type = other DNA
taatactactttcaaaag

SEQ ID NO: 71248 - DNA, 18 bp, synthetic construct
  source 1..18: mol_type = other DNA
taatagatcgtacaatag

SEQ ID NO: 71249 - DNA, 18 bp, synthetic construct
  source 1..18: mol_type = other DNA
taatagcactttttatag

SEQ ID NO: 71250 - DNA, 18 bp, synthetic construct
  source 1..18: mol_type = other DNA
taataggagtctctgaag

SEQ ID NO: 71251 - DNA, 18 bp, synthetic construct
  source 1..18: mol_type = other DNA
taataggtatcaatacag

SEQ ID NO: 71252 - DNA, 18 bp, synthetic construct
  source 1..18: mol_type = other DNA
taataggtttctctattg

SEQ ID NO: 71253 - DNA, 18 bp, synthetic construct
  source 1..18: mol_type = other DNA
taatataacttaataatg

SEQ ID NO: 71254 - DNA, 18 bp, synthetic construct
  source 1..18: mol_type = other DNA
taatataattcgctatgg

SEQ ID NO: 71255 - DNA, 18 bp, synthetic construct
  source 1..18: mol_type = other DNA
taatatgaaactcaatag

SEQ ID NO: 71256 - DNA, 18 bp, synthetic construct
  source 1..18: mol_type = other DNA
taatatgacaatttctag

SEQ ID NO: 71257 - DNA, 18 bp, synthetic construct
  source 1..18: mol_type = other DNA
taatatgtctaactaatg

SEQ ID NO: 71258 - DNA, 18 bp, synthetic construct
  source 1..18: mol_type = other DNA
taatccatcttaattttg

SEQ ID NO: 71259 - DNA, 18 bp, synthetic construct
  source 1..18: mol_type = other DNA
taatccgaatcacataag

SEQ ID NO: 71260 - DNA, 18 bp, synthetic construct
  source 1..18: mol_type = other DNA
taatccgacacacatttg

SEQ ID NO: 71261 - DNA, 18 bp, synthetic construct
  source 1..18: mol_type = other DNA
taatccgactcgatagtg

SEQ ID NO: 71262 - DNA, 18 bp, synthetic construct
  source 1..18: mol_type = other DNA
taatccgacttaccttcg

SEQ ID NO: 71263 - DNA, 18 bp, synthetic construct
  source 1..18: mol_type = other DNA
taatcctacacacttaag

SEQ ID NO: 71264 - DNA, 18 bp, synthetic construct
  source 1..18: mol_type = other DNA
taatccttctctgtatag

SEQ ID NO: 71265 - DNA, 18 bp, synthetic construct
  source 1..18: mol_type = other DNA
taatcggtcatactatag

SEQ ID NO: 71266 - DNA, 18 bp, synthetic construct
  source 1..18: mol_type = other DNA
taatgcatctccattttg

SEQ ID NO: 71267 - DNA, 18 bp, synthetic construct
  source 1..18: mol_type = other DNA
taatgcgtttctatatag

SEQ ID NO: 71268 - DNA, 18 bp, synthetic construct
  source 1..18: mol_type = other DNA
taatgcgtttctcaatag

SEQ ID NO: 71269 - DNA, 18 bp, synthetic construct
  source 1..18: mol_type = other DNA
taatgtgtctcattatcg

SEQ ID NO: 71270 - DNA, 18 bp, synthetic construct
  source 1..18: mol_type = other DNA
taattagactaactccgg

SEQ ID NO: 71271 - DNA, 18 bp, synthetic construct
  source 1..18: mol_type = other DNA
taattagtctcattttag

SEQ ID NO: 71272 - DNA, 18 bp, synthetic construct
  source 1..18: mol_type = other DNA
taattcaactcactgctg

SEQ ID NO: 71273 - DNA, 18 bp, synthetic construct
  source 1..18: mol_type = other DNA
taattcaactcatcttag

SEQ ID NO: 71274 - DNA, 18 bp, synthetic construct
  source 1..18: mol_type = other DNA
taattcatctcgcattag

SEQ ID NO: 71275 - DNA, 18 bp, synthetic construct
  source 1..18: mol_type = other DNA
taattccactttctacag

SEQ ID NO: 71276 - DNA, 18 bp, synthetic construct
  source 1..18: mol_type = other DNA
taattcctatgaatatag

SEQ ID NO: 71277 - DNA, 18 bp, synthetic construct
  source 1..18: mol_type = other DNA
taattcgaaaccctctag

SEQ ID NO: 71278 - DNA, 18 bp, synthetic construct
  source 1..18: mol_type = other DNA
taattcgacagaccttag

SEQ ID NO: 71279 - DNA, 18 bp, synthetic construct
  source 1..18: mol_type = other DNA
taattcgacttaattttg

SEQ ID NO: 71280 - DNA, 18 bp, synthetic construct
  source 1..18: mol_type = other DNA
taattcgagttccgtaag

SEQ ID NO: 71281 - DNA, 18 bp, synthetic construct
  source 1..18: mol_type = other DNA
taattcggctcgttgttg

SEQ ID NO: 71282 - DNA, 18 bp, synthetic construct
  source 1..18: mol_type = other DNA
taattcgtatcactaatg

SEQ ID NO: 71283 - DNA, 18 bp, synthetic construct
  source 1..18: mol_type = other DNA
taattcgtctcacataag

SEQ ID NO: 71284 - DNA, 18 bp, synthetic construct
  source 1..18: mol_type = other DNA
taattcgtctcagatctg

SEQ ID NO: 71285 - DNA, 18 bp, synthetic construct
  source 1..18: mol_type = other DNA
taattcgtctccctaatg

SEQ ID NO: 71286 - DNA, 18 bp, synthetic construct
  source 1..18: mol_type = other DNA
taattcgtcttactgtgg

SEQ ID NO: 71287 - DNA, 18 bp, synthetic construct
  source 1..18: mol_type = other DNA
taattcgtttctctttag

SEQ ID NO: 71288 - DNA, 18 bp, synthetic construct
  source 1..18: mol_type = other DNA
taattcgttttactattg

SEQ ID NO: 71289 - DNA, 18 bp, synthetic construct
  source 1..18: mol_type = other DNA
taattctacgtgatatag

SEQ ID NO: 71290 - DNA, 18 bp, synthetic construct
  source 1..18: mol_type = other DNA
taattctactacctttcg

SEQ ID NO: 71291 - DNA, 18 bp, synthetic construct
  source 1..18: mol_type = other DNA
taattctactcagttaag

SEQ ID NO: 71292 - DNA, 18 bp, synthetic construct
  source 1..18: mol_type = other DNA
taattcttctcactgaag

SEQ ID NO: 71293 - DNA, 18 bp, synthetic construct
  source 1..18: mol_type = other DNA
taattggaatttcatttg

SEQ ID NO: 71294 - DNA, 18 bp, synthetic construct
  source 1..18: mol_type = other DNA
taattggacatacaattg

SEQ ID NO: 71295 - DNA, 18 bp, synthetic construct
  source 1..18: mol_type = other DNA
taatttaacacactttag

SEQ ID NO: 71296 - DNA, 18 bp, synthetic construct
  source 1..18: mol_type = other DNA
tacaaaaactctctatag

SEQ ID NO: 71297 - DNA, 18 bp, synthetic construct
  source 1..18: mol_type = other DNA
tacaacgagtctttatag

SEQ ID NO: 71298 - DNA, 18 bp, synthetic construct
  source 1..18: mol_type = other DNA
tacaacgtctcactcgtg

SEQ ID NO: 71299 - DNA, 18 bp, synthetic construct
  source 1..18: mol_type = other DNA
tacaccgacacgttatag

SEQ ID NO: 71300 - DNA, 18 bp, synthetic construct
  source 1..18: mol_type = other DNA
tactacgactctcttatg

SEQ ID NO: 71301 - DNA, 18 bp, synthetic construct
  source 1..18: mol_type = other DNA
tactacgtctgtctctcg

SEQ ID NO: 71302 - DNA, 18 bp, synthetic construct
  source 1..18: mol_type = other DNA
tactacgtcttactacgg

SEQ ID NO: 71303 - DNA, 18 bp, synthetic construct
  source 1..18: mol_type = other DNA
tacttcgattcaataagg

SEQ ID NO: 71304 - DNA, 18 bp, synthetic construct
  source 1..18: mol_type = other DNA
tacttcgtctcactaatg

SEQ ID NO: 71305 - DNA, 18 bp, synthetic construct
  source 1..18: mol_type = other DNA
tacttcgtctgactaacg

SEQ ID NO: 71306 - DNA, 18 bp, synthetic construct
  source 1..18: mol_type = other DNA
tacttcgtcttataacag

SEQ ID NO: 71307 - DNA, 18 bp, synthetic construct
  source 1..18: mol_type = other DNA
tagatcgactcagtatcg

SEQ ID NO: 71308 - DNA, 18 bp, synthetic construct
  source 1..18: mol_type = other DNA
tagatcgtctcgctatag

SEQ ID NO: 71309 - DNA, 18 bp, synthetic construct
  source 1..18: mol_type = other DNA
tagcacaacgctcagcag

SEQ ID NO: 71310 - DNA, 18 bp, synthetic construct
  source 1..18: mol_type = other DNA
tagtaagccccaacatag

SEQ ID NO: 71311 - DNA, 18 bp, synthetic construct
  source 1..18: mol_type = other DNA
tagtacgacacatgctcg

SEQ ID NO: 71312 - DNA, 18 bp, synthetic construct
  source 1..18: mol_type = other DNA
tagtacgacaccctgtcg

SEQ ID NO: 71313 - DNA, 18 bp, synthetic construct
  source 1..18: mol_type = other DNA
tagtacgactttatacag

SEQ ID NO: 71314 - DNA, 18 bp, synthetic construct
  source 1..18: mol_type = other DNA
tagtacggctcaacattg

SEQ ID NO: 71315 - DNA, 18 bp, synthetic construct
  source 1..18: mol_type = other DNA
tagtacgttacactaaag

SEQ ID NO: 71316 - DNA, 18 bp, synthetic construct
  source 1..18: mol_type = other DNA
tagtccaatgcactacag

SEQ ID NO: 71317 - DNA, 18 bp, synthetic construct
  source 1..18: mol_type = other DNA
tagtgctaatcattattg

SEQ ID NO: 71318 - DNA, 18 bp, synthetic construct
  source 1..18: mol_type = other DNA
tagttcaacttacttaag

SEQ ID NO: 71319 - DNA, 18 bp, synthetic construct
  source 1..18: mol_type = other DNA
tagttccatcccctctcg

SEQ ID NO: 71320 - DNA, 18 bp, synthetic construct
  source 1..18: mol_type = other DNA
tataacgacactctttag

SEQ ID NO: 71321 - DNA, 18 bp, synthetic construct
  source 1..18: mol_type = other DNA
tataacgactaaaaatag

SEQ ID NO: 71322 - DNA, 18 bp, synthetic construct
  source 1..18: mol_type = other DNA
tataacgactttctctag

SEQ ID NO: 71323 - DNA, 18 bp, synthetic construct
  source 1..18: mol_type = other DNA
tataacgattcaatttag

SEQ ID NO: 71324 - DNA, 18 bp, synthetic construct
  source 1..18: mol_type = other DNA
tataacgatttacatcag

SEQ ID NO: 71325 - DNA, 18 bp, synthetic construct
  source 1..18: mol_type = other DNA
tataactaatcactattg

SEQ ID NO: 71326 - DNA, 18 bp, synthetic construct
  source 1..18: mol_type = other DNA
tataaggactcacgattg

SEQ ID NO: 71327 - DNA, 18 bp, synthetic construct
  source 1..18: mol_type = other DNA
tataagggctcactaaag

SEQ ID NO: 71328 - DNA, 18 bp, synthetic construct
  source 1..18: mol_type = other DNA
tatagcgacttactgtag

SEQ ID NO: 71329 - DNA, 18 bp, synthetic construct
  source 1..18: mol_type = other DNA
tatagcgactttctatag

SEQ ID NO: 71330 - DNA, 18 bp, synthetic construct
  source 1..18: mol_type = other DNA
tatagcgtctctctctag

SEQ ID NO: 71331 - DNA, 18 bp, synthetic construct
  source 1..18: mol_type = other DNA
tatatcaatttactattg

SEQ ID NO: 71332 - DNA, 18 bp, synthetic construct
  source 1..18: mol_type = other DNA
tatattgactctctatag

SEQ ID NO: 71333 - DNA, 18 bp, synthetic construct
  source 1..18: mol_type = other DNA
tatcaagactcacaattg

SEQ ID NO: 71334 - DNA, 18 bp, synthetic construct
  source 1..18: mol_type = other DNA
tatcacaagtaacatcag

SEQ ID NO: 71335 - DNA, 18 bp, synthetic construct
  source 1..18: mol_type = other DNA
tatcactactctcttaag

SEQ ID NO: 71336 - DNA, 18 bp, synthetic construct
  source 1..18: mol_type = other DNA
tatcagcattcactatag

SEQ ID NO: 71337 - DNA, 18 bp, synthetic construct
  source 1..18: mol_type = other DNA
tatcttaacttgctatag

SEQ ID NO: 71338 - DNA, 18 bp, synthetic construct
  source 1..18: mol_type = other DNA
tatcttgtatctctaaag

SEQ ID NO: 71339 - DNA, 18 bp, synthetic construct
  source 1..18: mol_type = other DNA
tatgacgactcgcttttg

SEQ ID NO: 71340 - DNA, 18 bp, synthetic construct
  source 1..18: mol_type = other DNA
tatgtcttctcactcaag

SEQ ID NO: 71341 - DNA, 18 bp, synthetic construct
  source 1..18: mol_type = other DNA
tattaagacactcaattg

SEQ ID NO: 71342 - DNA, 18 bp, synthetic construct
  source 1..18: mol_type = other DNA
tattaagtcccattatcg

SEQ ID NO: 71343 - DNA, 18 bp, synthetic construct
  source 1..18: mol_type = other DNA
tattacaactacgtaaag

SEQ ID NO: 71344 - DNA, 18 bp, synthetic construct
  source 1..18: mol_type = other DNA
tattacaataatcaattg

SEQ ID NO: 71345 - DNA, 18 bp, synthetic construct
  source 1..18: mol_type = other DNA
tattacagcgctctatag

SEQ ID NO: 71346 - DNA, 18 bp, synthetic construct
  source 1..18: mol_type = other DNA
tattacctatcgctacag

SEQ ID NO: 71347 - DNA, 18 bp, synthetic construct
  source 1..18: mol_type = other DNA
tattacctcattctatgg

SEQ ID NO: 71348 - DNA, 18 bp, synthetic construct
  source 1..18: mol_type = other DNA
tattacgaaaaaaaattg

SEQ ID NO: 71349 - DNA, 18 bp, synthetic construct
  source 1..18: mol_type = other DNA
tattacgacactcttttg

SEQ ID NO: 71350 - DNA, 18 bp, synthetic construct
  source 1..18: mol_type = other DNA
tattacgaccacatatag

SEQ ID NO: 71351 - DNA, 18 bp, synthetic construct
  source 1..18: mol_type = other DNA
tattacgactttctctcg

SEQ ID NO: 71352 - DNA, 18 bp, synthetic construct
  source 1..18: mol_type = other DNA
tattacgattctatctag

SEQ ID NO: 71353 - DNA, 18 bp, synthetic construct
  source 1..18: mol_type = other DNA
tattacggctaacttttg

SEQ ID NO: 71354 - DNA, 18 bp, synthetic construct
  source 1..18: mol_type = other DNA
tattacgtacacctaaag

SEQ ID NO: 71355 - DNA, 18 bp, synthetic construct
  source 1..18: mol_type = other DNA
tattacgtcacattattg

SEQ ID NO: 71356 - DNA, 18 bp, synthetic construct
  source 1..18: mol_type = other DNA
tattacgtctctccaaag

SEQ ID NO: 71357 - DNA, 18 bp, synthetic construct
  source 1..18: mol_type = other DNA
tattacgtgtcaaaatag

SEQ ID NO: 71358 - DNA, 18 bp, synthetic construct
  source 1..18: mol_type = other DNA
tattactaccagctatag

SEQ ID NO: 71359 - DNA, 18 bp, synthetic construct
  source 1..18: mol_type = other DNA
tattacttatcactatcg

SEQ ID NO: 71360 - DNA, 18 bp, synthetic construct
  source 1..18: mol_type = other DNA
tattacttattaatatag

SEQ ID NO: 71361 - DNA, 18 bp, synthetic construct
  source 1..18: mol_type = other DNA
tattacttcccactaaag

SEQ ID NO: 71362 - DNA, 18 bp, synthetic construct
  source 1..18: mol_type = other DNA
tattagtaatttctttag

SEQ ID NO: 71363 - DNA, 18 bp, synthetic construct
  source 1..18: mol_type = other DNA
tattatatcttactatag

SEQ ID NO: 71364 - DNA, 18 bp, synthetic construct
  source 1..18: mol_type = other DNA
tattatgaccatatatag

SEQ ID NO: 71365 - DNA, 18 bp, synthetic construct
  source 1..18: mol_type = other DNA
tattatgatccaccttag

SEQ ID NO: 71366 - DNA, 18 bp, synthetic construct
  source 1..18: mol_type = other DNA
tattatgtcacactgtag

SEQ ID NO: 71367 - DNA, 18 bp, synthetic construct
  source 1..18: mol_type = other DNA
tattcagactcacatttg

SEQ ID NO: 71368 - DNA, 18 bp, synthetic construct
  source 1..18: mol_type = other DNA
tattccgatgcccaatag

SEQ ID NO: 71369 - DNA, 18 bp, synthetic construct
  source 1..18: mol_type = other DNA
tattccgtctctatatag

SEQ ID NO: 71370 - DNA, 18 bp, synthetic construct
  source 1..18: mol_type = other DNA
tattgagacgcatgaaag

SEQ ID NO: 71371 - DNA, 18 bp, synthetic construct
  source 1..18: mol_type = other DNA
tattgttactatcgattg

SEQ ID NO: 71372 - DNA, 18 bp, synthetic construct
  source 1..18: mol_type = other DNA
tatttcaaatcacactag

SEQ ID NO: 71373 - DNA, 18 bp, synthetic construct
  source 1..18: mol_type = other DNA
tatttcaaatcactaaag

SEQ ID NO: 71374 - DNA, 18 bp, synthetic construct
  source 1..18: mol_type = other DNA
tatttcaattccctatag

SEQ ID NO: 71375 - DNA, 18 bp, synthetic construct
  source 1..18: mol_type = other DNA
tatttcgtatcacgattg

SEQ ID NO: 71376 - DNA, 18 bp, synthetic construct
  source 1..18: mol_type = other DNA
tatttcgtctcacaatcg

SEQ ID NO: 71377 - DNA, 18 bp, synthetic construct
  source 1..18: mol_type = other DNA
tatttctacttactaacg

SEQ ID NO: 71378 - DNA, 18 bp, synthetic construct
  source 1..18: mol_type = other DNA
tattttgtctacattacg

SEQ ID NO: 71379 - DNA, 18 bp, synthetic construct
  source 1..18: mol_type = other DNA
tcaaacgtttccatatag

SEQ ID NO: 71380 - DNA, 18 bp, synthetic construct
  source 1..18: mol_type = other DNA
tcaaactaaaaacaatcg

SEQ ID NO: 71381 - DNA, 18 bp, synthetic construct
  source 1..18: mol_type = other DNA
tcaaactattcactatcg

SEQ ID NO: 71382 - DNA, 18 bp, synthetic construct
  source 1..18: mol_type = other DNA
tcaatcgactcacaattg

SEQ ID NO: 71383 - DNA, 18 bp, synthetic construct
  source 1..18: mol_type = other DNA
tcaatctactcactaatg

SEQ ID NO: 71384 - DNA, 18 bp, synthetic construct
  source 1..18: mol_type = other DNA
tcaatggactcaccatag

SEQ ID NO: 71385 - DNA, 18 bp, synthetic construct
  source 1..18: mol_type = other DNA
tcatacgacactatttag

SEQ ID NO: 71386 - DNA, 18 bp, synthetic construct
  source 1..18: mol_type = other DNA
tcatacgacatacttaag

SEQ ID NO: 71387 - DNA, 18 bp, synthetic construct
  source 1..18: mol_type = other DNA
tcatacgatacattattg

SEQ ID NO: 71388 - DNA, 18 bp, synthetic construct
  source 1..18: mol_type = other DNA
tcatacgtctccatacag

SEQ ID NO: 71389 - DNA, 18 bp, synthetic construct
  source 1..18: mol_type = other DNA
tcatccgacactgaagag

SEQ ID NO: 71390 - DNA, 18 bp, synthetic construct
  source 1..18: mol_type = other DNA
tcatccgacctcatatag

SEQ ID NO: 71391 - DNA, 18 bp, synthetic construct
  source 1..18: mol_type = other DNA
tcatccgactcaacgtag

SEQ ID NO: 71392 - DNA, 18 bp, synthetic construct
  source 1..18: mol_type = other DNA
tcatctttcacttattag

SEQ ID NO: 71393 - DNA, 18 bp, synthetic construct
  source 1..18: mol_type = other DNA
tcatgcgtatcactattg

SEQ ID NO: 71394 - DNA, 18 bp, synthetic construct
  source 1..18: mol_type = other DNA
tcattagcctagccaaag

SEQ ID NO: 71395 - DNA, 18 bp, synthetic construct
  source 1..18: mol_type = other DNA
tcattcaacacagtatag

SEQ ID NO: 71396 - DNA, 18 bp, synthetic construct
  source 1..18: mol_type = other DNA
tcattcgactcaatcttg

SEQ ID NO: 71397 - DNA, 18 bp, synthetic construct
  source 1..18: mol_type = other DNA
tcattctacccagtacag

SEQ ID NO: 71398 - DNA, 18 bp, synthetic construct
  source 1..18: mol_type = other DNA
tcatttgacacccattag

SEQ ID NO: 71399 - DNA, 18 bp, synthetic construct
  source 1..18: mol_type = other DNA
tcatttgactcacgacag

SEQ ID NO: 71400 - DNA, 18 bp, synthetic construct
  source 1..18: mol_type = other DNA
tccaactactctctaatg

SEQ ID NO: 71401 - DNA, 18 bp, synthetic construct
  source 1..18: mol_type = other DNA
tcttacgactcgctaccg

SEQ ID NO: 71402 - DNA, 18 bp, synthetic construct
  source 1..18: mol_type = other DNA
tcttactactctctattg

SEQ ID NO: 71403 - DNA, 18 bp, synthetic construct
  source 1..18: mol_type = other DNA
tgaaacaacacactaaag

SEQ ID NO: 71404 - DNA, 18 bp, synthetic construct
  source 1..18: mol_type = other DNA
tgacacgtcacagagtag

SEQ ID NO: 71405 - DNA, 18 bp, synthetic construct
  source 1..18: mol_type = other DNA
tgataagaatcactaagg

SEQ ID NO: 71406 - DNA, 18 bp, synthetic construct
  source 1..18: mol_type = other DNA
tgatactccccactttag

SEQ ID NO: 71407 - DNA, 18 bp, synthetic construct
  source 1..18: mol_type = other DNA
tgattcgtctcaccattg

SEQ ID NO: 71408 - DNA, 18 bp, synthetic construct
  source 1..18: mol_type = other DNA
tgattctactcattcttg

SEQ ID NO: 71409 - DNA, 18 bp, synthetic construct
  source 1..18: mol_type = other DNA
tgcttcgactcactcctg

SEQ ID NO: 71410 - DNA, 18 bp, synthetic construct
  source 1..18: mol_type = other DNA
tggaacgatttggtacag

SEQ ID NO: 71411 - DNA, 18 bp, synthetic construct
  source 1..18: mol_type = other DNA
tgtaaccacttactatag

SEQ ID NO: 71412 - DNA, 18 bp, synthetic construct
  source 1..18: mol_type = other DNA
tgtcatgtttccctaaag

SEQ ID NO: 71413 - DNA, 18 bp, synthetic construct
  source 1..18: mol_type = other DNA
tgttacgtcttactttag

SEQ ID NO: 71414 - DNA, 18 bp, synthetic construct
  source 1..18: mol_type = other DNA
tgttgagaatctctatag

SEQ ID NO: 71415 - DNA, 18 bp, synthetic construct
  source 1..18: mol_type = other DNA
ttaaacatctcacaacag

SEQ ID NO: 71416 - DNA, 18 bp, synthetic construct
  source 1..18: mol_type = other DNA
ttaaacatctcactttag

SEQ ID NO: 71417 - DNA, 18 bp, synthetic construct
  source 1..18: mol_type = other DNA
ttaaacgagtcacattag

SEQ ID NO: 71418 - DNA, 18 bp, synthetic construct
  source 1..18: mol_type = other DNA
ttaaacgtttcaatatag

SEQ ID NO: 71419 - DNA, 18 bp, synthetic construct
  source 1..18: mol_type = other DNA
ttaaagctctctcttgag

SEQ ID NO: 71420 - DNA, 18 bp, synthetic construct
  source 1..18: mol_type = other DNA
ttaagttcctcactaaag

SEQ ID NO: 71421 - DNA, 18 bp, synthetic construct
  source 1..18: mol_type = other DNA
ttaatcctctcactatag

SEQ ID NO: 71422 - DNA, 18 bp, synthetic construct
  source 1..18: mol_type = other DNA
ttaatcgactcactttgg

SEQ ID NO: 71423 - DNA, 18 bp, synthetic construct
  source 1..18: mol_type = other DNA
ttaatcggctcaccatag

SEQ ID NO: 71424 - DNA, 18 bp, synthetic construct
  source 1..18: mol_type = other DNA
ttaatctattgactatag

SEQ ID NO: 71425 - DNA, 18 bp, synthetic construct
  source 1..18: mol_type = other DNA
ttacacgacttacttttg

SEQ ID NO: 71426 - DNA, 18 bp, synthetic construct
  source 1..18: mol_type = other DNA
ttacattacacacattag

SEQ ID NO: 71427 - DNA, 18 bp, synthetic construct
  source 1..18: mol_type = other DNA
ttaccggactcagtatag

SEQ ID NO: 71428 - DNA, 18 bp, synthetic construct
  source 1..18: mol_type = other DNA
ttacgcgactcattaaag

SEQ ID NO: 71429 - DNA, 18 bp, synthetic construct
  source 1..18: mol_type = other DNA
ttagccgattcgctattg

SEQ ID NO: 71430 - DNA, 18 bp, synthetic construct
  source 1..18: mol_type = other DNA
ttagtcgtctcacataag

SEQ ID NO: 71431 - DNA, 18 bp, synthetic construct
  source 1..18: mol_type = other DNA
ttataaaacacactattg

SEQ ID NO: 71432 - DNA, 18 bp, synthetic construct
  source 1..18: mol_type = other DNA
ttataagacatacatcgg

SEQ ID NO: 71433 - DNA, 18 bp, synthetic construct
  source 1..18: mol_type = other DNA
ttataatgttctcttttg

SEQ ID NO: 71434 - DNA, 18 bp, synthetic construct
  source 1..18: mol_type = other DNA
ttatacaaatcacaattg

SEQ ID NO: 71435 - DNA, 18 bp, synthetic construct
  source 1..18: mol_type = other DNA
ttatacaactaacaaagg

SEQ ID NO: 71436 - DNA, 18 bp, synthetic construct
  source 1..18: mol_type = other DNA
ttatacatcacattagag

SEQ ID NO: 71437 - DNA, 18 bp, synthetic construct
  source 1..18: mol_type = other DNA
ttatacatgtcaccatag

SEQ ID NO: 71438 - DNA, 18 bp, synthetic construct
  source 1..18: mol_type = other DNA
ttataccacatattttag

SEQ ID NO: 71439 - DNA, 18 bp, synthetic construct
  source 1..18: mol_type = other DNA
ttataccactcacccaag

SEQ ID NO: 71440 - DNA, 18 bp, synthetic construct
  source 1..18: mol_type = other DNA
ttataccctgcacgatag

SEQ ID NO: 71441 - DNA, 18 bp, synthetic construct
  source 1..18: mol_type = other DNA
ttatacgaaacatcatag

SEQ ID NO: 71442 - DNA, 18 bp, synthetic construct
  source 1..18: mol_type = other DNA
ttatacgaacttccttag

SEQ ID NO: 71443 - DNA, 18 bp, synthetic construct
  source 1..18: mol_type = other DNA
ttatacgaattacaaaag

SEQ ID NO: 71444 - DNA, 18 bp, synthetic construct
  source 1..18: mol_type = other DNA
ttatacgacaaacataag

SEQ ID NO: 71445 - DNA, 18 bp, synthetic construct
  source 1..18: mol_type = other DNA
ttatacgacaaaccatcg

SEQ ID NO: 71446 - DNA, 18 bp, synthetic construct
  source 1..18: mol_type = other DNA
ttatacgtcacgcaatag

SEQ ID NO: 71447 - DNA, 18 bp, synthetic construct
  source 1..18: mol_type = other DNA
ttatacgtccaacgaaag

SEQ ID NO: 71448 - DNA, 18 bp, synthetic construct
  source 1..18: mol_type = other DNA
ttatacgtcgctctattg

SEQ ID NO: 71449 - DNA, 18 bp, synthetic construct
  source 1..18: mol_type = other DNA
ttatacgtctcagcttag

SEQ ID NO: 71450 - DNA, 18 bp, synthetic construct
  source 1..18: mol_type = other DNA
ttatacgtctctccacag

SEQ ID NO: 71451 - DNA, 18 bp, synthetic construct
  source 1..18: mol_type = other DNA
ttatacgtctctccagcg

SEQ ID NO: 71452 - DNA, 18 bp, synthetic construct
  source 1..18: mol_type = other DNA
ttatacgtttaacaatag

SEQ ID NO: 71453 - DNA, 18 bp, synthetic construct
  source 1..18: mol_type = other DNA
ttatacgtttaactacag

SEQ ID NO: 71454 - DNA, 18 bp, synthetic construct
  source 1..18: mol_type = other DNA
ttatacgtttctctaaag

SEQ ID NO: 71455 - DNA, 18 bp, synthetic construct
  source 1..18: mol_type = other DNA
ttatacgtttctctattg

SEQ ID NO: 71456 - DNA, 18 bp, synthetic construct
  source 1..18: mol_type = other DNA
ttatactactcaacttag

SEQ ID NO: 71457 - DNA, 18 bp, synthetic construct
  source 1..18: mol_type = other DNA
ttatactattctcaatag

SEQ ID NO: 71458 - DNA, 18 bp, synthetic construct
  source 1..18: mol_type = other DNA
ttatactgcgagccatag

SEQ ID NO: 71459 - DNA, 18 bp, synthetic construct
  source 1..18: mol_type = other DNA
ttatagaattcactattg

SEQ ID NO: 71460 - DNA, 18 bp, synthetic construct
  source 1..18: mol_type = other DNA
ttataggactaacaaatg

SEQ ID NO: 71461 - DNA, 18 bp, synthetic construct
  source 1..18: mol_type = other DNA
ttataggcttcactaaag

SEQ ID NO: 71462 - DNA, 18 bp, synthetic construct
  source 1..18: mol_type = other DNA
ttatagggttcgcaacag

SEQ ID NO: 71463 - DNA, 18 bp, synthetic construct
  source 1..18: mol_type = other DNA
ttataggtatcttcatag

SEQ ID NO: 71464 - DNA, 18 bp, synthetic construct
  source 1..18: mol_type = other DNA
ttatataactcgatatag

SEQ ID NO: 71465 - DNA, 18 bp, synthetic construct
  source 1..18: mol_type = other DNA
ttatatgtttcactcttg

SEQ ID NO: 71466 - DNA, 18 bp, synthetic construct
  source 1..18: mol_type = other DNA
ttatgcgacactctttag

SEQ ID NO: 71467 - DNA, 18 bp, synthetic construct
  source 1..18: mol_type = other DNA
ttatgcgtttcactatcg

SEQ ID NO: 71468 - DNA, 18 bp, synthetic construct
  source 1..18: mol_type = other DNA
ttatgtgactcacttgag

SEQ ID NO: 71469 - DNA, 18 bp, synthetic construct
  source 1..18: mol_type = other DNA
ttatgtgtctcttattag

SEQ ID NO: 71470 - DNA, 18 bp, synthetic construct
  source 1..18: mol_type = other DNA
ttattagacacacaatag

SEQ ID NO: 71471 - DNA, 18 bp, synthetic construct
  source 1..18: mol_type = other DNA
ttattagactctctattg

SEQ ID NO: 71472 - DNA, 18 bp, synthetic construct
  source 1..18: mol_type = other DNA
ttattccactcacaaaag

SEQ ID NO: 71473 - DNA, 18 bp, synthetic construct
  source 1..18: mol_type = other DNA
ttattcgaaccactttag

SEQ ID NO: 71474 - DNA, 18 bp, synthetic construct
  source 1..18: mol_type = other DNA
ttattcgacacatttaag

SEQ ID NO: 71475 - DNA, 18 bp, synthetic construct
  source 1..18: mol_type = other DNA
ttattcgacccgctttag

SEQ ID NO: 71476 - DNA, 18 bp, synthetic construct
  source 1..18: mol_type = other DNA
ttattcgacttattattg

SEQ ID NO: 71477 - DNA, 18 bp, synthetic construct
  source 1..18: mol_type = other DNA
ttattctaatcactatcg

SEQ ID NO: 71478 - DNA, 18 bp, synthetic construct
  source 1..18: mol_type = other DNA
ttattggactgccaattg

SEQ ID NO: 71479 - DNA, 18 bp, synthetic construct
  source 1..18: mol_type = other DNA
ttcaacgacttataatag

SEQ ID NO: 71480 - DNA, 18 bp, synthetic construct
  source 1..18: mol_type = other DNA
ttcatcgactttcactag

SEQ ID NO: 71481 - DNA, 18 bp, synthetic construct
  source 1..18: mol_type = other DNA
ttctacgacatggtattg

SEQ ID NO: 71482 - DNA, 18 bp, synthetic construct
  source 1..18: mol_type = other DNA
ttctacgattcaattaag

SEQ ID NO: 71483 - DNA, 18 bp, synthetic construct
  source 1..18: mol_type = other DNA
ttctccgaatcactattg

SEQ ID NO: 71484 - DNA, 18 bp, synthetic construct
  source 1..18: mol_type = other DNA
ttcttcgactaacaatag

SEQ ID NO: 71485 - DNA, 18 bp, synthetic construct
  source 1..18: mol_type = other DNA
ttgcacaactccctatag

SEQ ID NO: 71486 - DNA, 18 bp, synthetic construct
  source 1..18: mol_type = other DNA
ttgtacgaatctttatag

SEQ ID NO: 71487 - DNA, 18 bp, synthetic construct
  source 1..18: mol_type = other DNA
ttgtacgacttattttag

SEQ ID NO: 71488 - DNA, 18 bp, synthetic construct
  source 1..18: mol_type = other DNA
ttgtataactctttatag

SEQ ID NO: 71489 - DNA, 18 bp, synthetic construct
  source 1..18: mol_type = other DNA
ttgttagactaaataccg

SEQ ID NO: 71490 - DNA, 18 bp, synthetic construct
  source 1..18: mol_type = other DNA
tttaaaatcccactatag

SEQ ID NO: 71491 - DNA, 18 bp, synthetic construct
  source 1..18: mol_type = other DNA
tttaacaacagactatag

SEQ ID NO: 71492 - DNA, 18 bp, synthetic construct
  source 1..18: mol_type = other DNA
tttaacaactcactaaag

SEQ ID NO: 71493 - DNA, 18 bp, synthetic construct
  source 1..18: mol_type = other DNA
tttaacgactcagtatcg

SEQ ID NO: 71494 - DNA, 18 bp, synthetic construct
  source 1..18: mol_type = other DNA
tttatcgtctcactatag

SEQ ID NO: 71495 - DNA, 18 bp, synthetic construct
  source 1..18: mol_type = other DNA
tttatcgtgtcacgatag

SEQ ID NO: 71496 - DNA, 18 bp, synthetic construct
  source 1..18: mol_type = other DNA
tttatgaacttattatag

SEQ ID NO: 71497 - DNA, 18 bp, synthetic construct
  source 1..18: mol_type = other DNA
ttttacgaaccaccattg

SEQ ID NO: 71498 - DNA, 18 bp, synthetic construct
  source 1..18: mol_type = other DNA
ttttacgacacgctttag

SEQ ID NO: 71499 - DNA, 18 bp, synthetic construct
  source 1..18: mol_type = other DNA
ttttacgactcgcttttg

SEQ ID NO: 71500 - DNA, 18 bp, synthetic construct
  source 1..18: mol_type = other DNA
ttttacgtcttactattg

SEQ ID NO: 71501 - DNA, 18 bp, synthetic construct
  source 1..18: mol_type = other DNA
ttttactactcattttag

SEQ ID NO: 71502 - DNA, 18 bp, synthetic construct
  source 1..18: mol_type = other DNA
ttttactactgtctatag

SEQ ID NO: 71503 - DNA, 18 bp, synthetic construct
  source 1..18: mol_type = other DNA
ttttaggcctcaccacag

SEQ ID NO: 71504 - DNA, 18 bp, synthetic construct
  source 1..18: mol_type = other DNA
ttttaggtctcacaatag

SEQ ID NO: 71505 - DNA, 18 bp, synthetic construct
  source 1..18: mol_type = other DNA
ttttatgttttactttag

SEQ ID NO: 71506 - DNA, 18 bp, synthetic construct
  source 1..18: mol_type = other DNA
tattacctctctctattg

SEQ ID NO: 71507 - DNA, 18 bp, synthetic construct
  source 1..18: mol_type = other DNA
aataacgtctcactaaag

SEQ ID NO: 71508 - DNA, 18 bp, synthetic construct
  source 1..18: mol_type = other DNA
taatacaacactcttttg

SEQ ID NO: 71509 - DNA, 18 bp, synthetic construct
  source 1..18: mol_type = other DNA
tcatacatcacacattag

SEQ ID NO: 71510 - DNA, 18 bp, synthetic construct
  source 1..18: mol_type = other DNA
ttataggattcaccactg

SEQ ID NO: 71511 - DNA, 18 bp, synthetic construct
  source 1..18: mol_type = other DNA
taaaacgacaagcaatag

SEQ ID NO: 71512 - DNA, 18 bp, synthetic construct
  source 1..18: mol_type = other DNA
aagtacggatcactattg

SEQ ID NO: 71513 - DNA, 18 bp, synthetic construct
  source 1..18: mol_type = other DNA
aattacgtctctctattg

SEQ ID NO: 71514 - DNA, 18 bp, synthetic construct
  source 1..18: mol_type = other DNA
atatacctcacactatag

SEQ ID NO: 71515 - DNA, 18 bp, synthetic construct
  source 1..18: mol_type = other DNA
tataacgattcaatacag

SEQ ID NO: 71516 - DNA, 18 bp, synthetic construct
  source 1..18: mol_type = other DNA
tatcacgactcgcttatg

SEQ ID NO: 71517 - DNA, 18 bp, synthetic construct
  source 1..18: mol_type = other DNA
aaaaacgacttacattag

SEQ ID NO: 71518 - DNA, 18 bp, synthetic construct
  source 1..18: mol_type = other DNA
aaaaacgtgtcactattg

SEQ ID NO: 71519 - DNA, 18 bp, synthetic construct
  source 1..18: mol_type = other DNA
aaaaactactctctttag

SEQ ID NO: 71520 - DNA, 18 bp, synthetic construct
  source 1..18: mol_type = other DNA
aaaactgactcactattg

SEQ ID NO: 71521 - DNA, 18 bp, synthetic construct
  source 1..18: mol_type = other DNA
aaaatcgactcactgttg

SEQ ID NO: 71522 - DNA, 18 bp, synthetic construct
  source 1..18: mol_type = other DNA
aaacacaattgtctatag

SEQ ID NO: 71523 - DNA, 18 bp, synthetic construct
  source 1..18: mol_type = other DNA
aaacacgtctttctattg

SEQ ID NO: 71524 - DNA, 18 bp, synthetic construct
  source 1..18: mol_type = other DNA
aaagcagactcactaaag

SEQ ID NO: 71525 - DNA, 18 bp, synthetic construct
  source 1..18: mol_type = other DNA
aaatacaacactctttag

SEQ ID NO: 71526 - DNA, 18 bp, synthetic construct
  source 1..18: mol_type = other DNA
aaatacaactctcttaag

SEQ ID NO: 71527 - DNA, 18 bp, synthetic construct
  source 1..18: mol_type = other DNA
aaatacagcataatattg

SEQ ID NO: 71528 - DNA, 18 bp, synthetic construct
  source 1..18: mol_type = other DNA
aaatacgaaacaccatcg

SEQ ID NO: 71529 - DNA, 18 bp, synthetic construct
  source 1..18: mol_type = other DNA
aaatacgacacaataatg

SEQ ID NO: 71530 - DNA, 18 bp, synthetic construct
  source 1..18: mol_type = other DNA
aaatacgacactaaatag

SEQ ID NO: 71531 - DNA, 18 bp, synthetic construct
  source 1..18: mol_type = other DNA
aaatacgacagacattag

SEQ ID NO: 71532 - DNA, 18 bp, synthetic construct
  source 1..18: mol_type = other DNA
aaatacgactaacttatg

SEQ ID NO: 71533 - DNA, 18 bp, synthetic construct
  source 1..18: mol_type = other DNA
aaatactacacattaaag

SEQ ID NO: 71534 - DNA, 18 bp, synthetic construct
  source 1..18: mol_type = other DNA
aaatactattctctaaag

SEQ ID NO: 71535 - DNA, 18 bp, synthetic construct
  source 1..18: mol_type = other DNA
aaatagccttcactatag

SEQ ID NO: 71536 - DNA, 18 bp, synthetic construct
  source 1..18: mol_type = other DNA
aaattcatctcacattag

SEQ ID NO: 71537 - DNA, 18 bp, synthetic construct
  source 1..18: mol_type = other DNA
aaattcgccactctatag

SEQ ID NO: 71538 - DNA, 18 bp, synthetic construct
  source 1..18: mol_type = other DNA
aaattcgtcttacaatag

SEQ ID NO: 71539 - DNA, 18 bp, synthetic construct
  source 1..18: mol_type = other DNA
aacatcgatacacctttg

SEQ ID NO: 71540 - DNA, 18 bp, synthetic construct
  source 1..18: mol_type = other DNA
aactacatctcacaattg

SEQ ID NO: 71541 - DNA, 18 bp, synthetic construct
  source 1..18: mol_type = other DNA
aacttcaactctctatag

SEQ ID NO: 71542 - DNA, 18 bp, synthetic construct
  source 1..18: mol_type = other DNA
aagcacgtgtctattcag

SEQ ID NO: 71543 - DNA, 18 bp, synthetic construct
  source 1..18: mol_type = other DNA
aataacgattcggtatcg

SEQ ID NO: 71544 - DNA, 18 bp, synthetic construct
  source 1..18: mol_type = other DNA
aattaaggctcaatatag

SEQ ID NO: 71545 - DNA, 18 bp, synthetic construct
  source 1..18: mol_type = other DNA
aattacgacactctattg

SEQ ID NO: 71546 - DNA, 18 bp, synthetic construct
  source 1..18: mol_type = other DNA
aattacgactcacaaatg

SEQ ID NO: 71547 - DNA, 18 bp, synthetic construct
  source 1..18: mol_type = other DNA
aattacggctcgatatag

SEQ ID NO: 71548 - DNA, 18 bp, synthetic construct
  source 1..18: mol_type = other DNA
aattacgtcttactattg

SEQ ID NO: 71549 - DNA, 18 bp, synthetic construct
  source 1..18: mol_type = other DNA
aattactactcatcatag

SEQ ID NO: 71550 - DNA, 18 bp, synthetic construct
  source 1..18: mol_type = other DNA
aattactactgacaatag

SEQ ID NO: 71551 - DNA, 18 bp, synthetic construct
  source 1..18: mol_type = other DNA
aattacttcacaatatag

SEQ ID NO: 71552 - DNA, 18 bp, synthetic construct
  source 1..18: mol_type = other DNA
acaatggacagactatag

SEQ ID NO: 71553 - DNA, 18 bp, synthetic construct
  source 1..18: mol_type = other DNA
acactcgtctcactatag

SEQ ID NO: 71554 - DNA, 18 bp, synthetic construct
  source 1..18: mol_type = other DNA
acatatgtttcactatag

SEQ ID NO: 71555 - DNA, 18 bp, synthetic construct
  source 1..18: mol_type = other DNA
acatccgactcgctacag

SEQ ID NO: 71556 - DNA, 18 bp, synthetic construct
  source 1..18: mol_type = other DNA
acattcaactcacaatag

SEQ ID NO: 71557 - DNA, 18 bp, synthetic construct
  source 1..18: mol_type = other DNA
acttagaactcattttag

SEQ ID NO: 71558 - DNA, 18 bp, synthetic construct
  source 1..18: mol_type = other DNA
agatacgattttctttag

SEQ ID NO: 71559 - DNA, 18 bp, synthetic construct
  source 1..18: mol_type = other DNA
agatacgtctcaatattg

SEQ ID NO: 71560 - DNA, 18 bp, synthetic construct
  source 1..18: mol_type = other DNA
agatgcgacacacattgg

SEQ ID NO: 71561 - DNA, 18 bp, synthetic construct
  source 1..18: mol_type = other DNA
agatgcgtctatcaaaag

SEQ ID NO: 71562 - DNA, 18 bp, synthetic construct
  source 1..18: mol_type = other DNA
agattccaccccgatttg

SEQ ID NO: 71563 - DNA, 18 bp, synthetic construct
  source 1..18: mol_type = other DNA
agttatgactcacttaag

SEQ ID NO: 71564 - DNA, 18 bp, synthetic construct
  source 1..18: mol_type = other DNA
ataaacgattcattaaag

SEQ ID NO: 71565 - DNA, 18 bp, synthetic construct
  source 1..18: mol_type = other DNA
atacaagactcactaaag

SEQ ID NO: 71566 - DNA, 18 bp, synthetic construct
  source 1..18: mol_type = other DNA
atagacaactcactattg

SEQ ID NO: 71567 - DNA, 18 bp, synthetic construct
  source 1..18: mol_type = other DNA
atagacgtctcaataaag

SEQ ID NO: 71568 - DNA, 18 bp, synthetic construct
  source 1..18: mol_type = other DNA
atataagacatactatag

SEQ ID NO: 71569 - DNA, 18 bp, synthetic construct
  source 1..18: mol_type = other DNA
atataagactcacttgag

SEQ ID NO: 71570 - DNA, 18 bp, synthetic construct
  source 1..18: mol_type = other DNA
atatacacctcattatag

SEQ ID NO: 71571 - DNA, 18 bp, synthetic construct
  source 1..18: mol_type = other DNA
atataccagtccctatag

SEQ ID NO: 71572 - DNA, 18 bp, synthetic construct
  source 1..18: mol_type = other DNA
atatacgaatctctaaag

SEQ ID NO: 71573 - DNA, 18 bp, synthetic construct
  source 1..18: mol_type = other DNA
atatacgattttctatag

SEQ ID NO: 71574 - DNA, 18 bp, synthetic construct
  source 1..18: mol_type = other DNA
atatccgattaaccatag

SEQ ID NO: 71575 - DNA, 18 bp, synthetic construct
  source 1..18: mol_type = other DNA
atatgcgaccccttatag

SEQ ID NO: 71576 - DNA, 18 bp, synthetic construct
  source 1..18: mol_type = other DNA
atatgcgaccctcaatag

SEQ ID NO: 71577 - DNA, 18 bp, synthetic construct
  source 1..18: mol_type = other DNA
atctacgcctcacaatag

SEQ ID NO: 71578 - DNA, 18 bp, synthetic construct
  source 1..18: mol_type = other DNA
atgaactactaacaatag

SEQ ID NO: 71579 - DNA, 18 bp, synthetic construct
  source 1..18: mol_type = other DNA
atgttcgactcactttag

SEQ ID NO: 71580 - DNA, 18 bp, synthetic construct
  source 1..18: mol_type = other DNA
atgttcgactctctaaag

SEQ ID NO: 71581 - DNA, 18 bp, synthetic construct
  source 1..18: mol_type = other DNA
attcccgactcacaaatg

SEQ ID NO: 71582 - DNA, 18 bp, synthetic construct
  source 1..18: mol_type = other DNA
attcccgccactctattg

SEQ ID NO: 71583 - DNA, 18 bp, synthetic construct
  source 1..18: mol_type = other DNA
atttacgacatacaaaag

SEQ ID NO: 71584 - DNA, 18 bp, synthetic construct
  source 1..18: mol_type = other DNA
atttacgtctctctatag

SEQ ID NO: 71585 - DNA, 18 bp, synthetic construct
  source 1..18: mol_type = other DNA
atttccttcacattaaag

SEQ ID NO: 71586 - DNA, 18 bp, synthetic construct
  source 1..18: mol_type = other DNA
attttcgtttcactctag

SEQ ID NO: 71587 - DNA, 18 bp, synthetic construct
  source 1..18: mol_type = other DNA
caaaacgactccatattg

SEQ ID NO: 71588 - DNA, 18 bp, synthetic construct
  source 1..18: mol_type = other DNA
caacaccgtaactttaag

SEQ ID NO: 71589 - DNA, 18 bp, synthetic construct
  source 1..18: mol_type = other DNA
caactcgtcaaactaatg

SEQ ID NO: 71590 - DNA, 18 bp, synthetic construct
  source 1..18: mol_type = other DNA
caataccagaaaataaag

SEQ ID NO: 71591 - DNA, 18 bp, synthetic construct
  source 1..18: mol_type = other DNA
caatacgacactcattag

SEQ ID NO: 71592 - DNA, 18 bp, synthetic construct
  source 1..18: mol_type = other DNA
caatacgtcactcaatag

SEQ ID NO: 71593 - DNA, 18 bp, synthetic construct
  source 1..18: mol_type = other DNA
caatgcaacttaccatag

SEQ ID NO: 71594 - DNA, 18 bp, synthetic construct
  source 1..18: mol_type = other DNA
caattcgtattactatag

SEQ ID NO: 71595 - DNA, 18 bp, synthetic construct
  source 1..18: mol_type = other DNA
caattcgtcacgctatag

SEQ ID NO: 71596 - DNA, 18 bp, synthetic construct
  source 1..18: mol_type = other DNA
cacctcgtctcatcaccg

SEQ ID NO: 71597 - DNA, 18 bp, synthetic construct
  source 1..18: mol_type = other DNA
cactacttctcacaattg

SEQ ID NO: 71598 - DNA, 18 bp, synthetic construct
  source 1..18: mol_type = other DNA
cattaccactcgcttaag

SEQ ID NO: 71599 - DNA, 18 bp, synthetic construct
  source 1..18: mol_type = other DNA
cattacgactctccaatg

SEQ ID NO: 71600 - DNA, 18 bp, synthetic construct
  source 1..18: mol_type = other DNA
cattagggcacactaatg

SEQ ID NO: 71601 - DNA, 18 bp, synthetic construct
  source 1..18: mol_type = other DNA
cattatgattcacaatag

SEQ ID NO: 71602 - DNA, 18 bp, synthetic construct
  source 1..18: mol_type = other DNA
catttggatcctctatag

SEQ ID NO: 71603 - DNA, 18 bp, synthetic construct
  source 1..18: mol_type = other DNA
ccaaaccactcactaaag

SEQ ID NO: 71604 - DNA, 18 bp, synthetic construct
  source 1..18: mol_type = other DNA
cgatgtgtctcactatag

SEQ ID NO: 71605 - DNA, 18 bp, synthetic construct
  source 1..18: mol_type = other DNA
ctaacccactcactatag

SEQ ID NO: 71606 - DNA, 18 bp, synthetic construct
  source 1..18: mol_type = other DNA
ctatacgtaactctatag

SEQ ID NO: 71607 - DNA, 18 bp, synthetic construct
  source 1..18: mol_type = other DNA
ctatattattcactaaag

SEQ ID NO: 71608 - DNA, 18 bp, synthetic construct
  source 1..18: mol_type = other DNA
ctatgcgacacactcttg

SEQ ID NO: 71609 - DNA, 18 bp, synthetic construct
  source 1..18: mol_type = other DNA
ctatgcgtttcactatag

SEQ ID NO: 71610 - DNA, 18 bp, synthetic construct
  source 1..18: mol_type = other DNA
ctttacaattcacagtag

SEQ ID NO: 71611 - DNA, 18 bp, synthetic construct
  source 1..18: mol_type = other DNA
gaatacaactcgttattg

SEQ ID NO: 71612 - DNA, 18 bp, synthetic construct
  source 1..18: mol_type = other DNA
gaatacctctttccatag

SEQ ID NO: 71613 - DNA, 18 bp, synthetic construct
  source 1..18: mol_type = other DNA
gaatacgcctctcttttg

SEQ ID NO: 71614 - DNA, 18 bp, synthetic construct
  source 1..18: mol_type = other DNA
gattgcgaatctcttcag

SEQ ID NO: 71615 - DNA, 18 bp, synthetic construct
  source 1..18: mol_type = other DNA
gatttcgacttactaatg

SEQ ID NO: 71616 - DNA, 18 bp, synthetic construct
  source 1..18: mol_type = other DNA
gcatactactatcgatag

SEQ ID NO: 71617 - DNA, 18 bp, synthetic construct
  source 1..18: mol_type = other DNA
gtacaccactcacaatag

SEQ ID NO: 71618 - DNA, 18 bp, synthetic construct
  source 1..18: mol_type = other DNA
gttttcgaatcacaatag

SEQ ID NO: 71619 - DNA, 18 bp, synthetic construct
  source 1..18: mol_type = other DNA
taaaaatactcacaagag

SEQ ID NO: 71620 - DNA, 18 bp, synthetic construct
  source 1..18: mol_type = other DNA
taaaacaacttacaaaag

SEQ ID NO: 71621 - DNA, 18 bp, synthetic construct
  source 1..18: mol_type = other DNA
taaaacaattcgatatag

SEQ ID NO: 71622 - DNA, 18 bp, synthetic construct
  source 1..18: mol_type = other DNA
taaaacatcacactatcg

SEQ ID NO: 71623 - DNA, 18 bp, synthetic construct
  source 1..18: mol_type = other DNA
taaaacatctctctaaag

SEQ ID NO: 71624 - DNA, 18 bp, synthetic construct
  source 1..18: mol_type = other DNA
taaaaccacactcaatag

SEQ ID NO: 71625 - DNA, 18 bp, synthetic construct
  source 1..18: mol_type = other DNA
taaaacgaatctgtattg

SEQ ID NO: 71626 - DNA, 18 bp, synthetic construct
  source 1..18: mol_type = other DNA
taaaacgaatgaccacag

SEQ ID NO: 71627 - DNA, 18 bp, synthetic construct
  source 1..18: mol_type = other DNA
taaaacgacacaccaatg

SEQ ID NO: 71628 - DNA, 18 bp, synthetic construct
  source 1..18: mol_type = other DNA
taaaacgacagacaattg

SEQ ID NO: 71629 - DNA, 18 bp, synthetic construct
  source 1..18: mol_type = other DNA
taaaacgacttacatttg

SEQ ID NO: 71630 - DNA, 18 bp, synthetic construct
  source 1..18: mol_type = other DNA
taaaacgtcactccatag

SEQ ID NO: 71631 - DNA, 18 bp, synthetic construct
  source 1..18: mol_type = other DNA
taaaacgtctaacaaaag

SEQ ID NO: 71632 - DNA, 18 bp, synthetic construct
  source 1..18: mol_type = other DNA
taaaacgtctgaataatg

SEQ ID NO: 71633 - DNA, 18 bp, synthetic construct
  source 1..18: mol_type = other DNA
taaaactaatcacttgtg

SEQ ID NO: 71634 - DNA, 18 bp, synthetic construct
  source 1..18: mol_type = other DNA
taaaacttttcactattg

SEQ ID NO: 71635 - DNA, 18 bp, synthetic construct
  source 1..18: mol_type = other DNA
taaaaggagacaatatag

SEQ ID NO: 71636 - DNA, 18 bp, synthetic construct
  source 1..18: mol_type = other DNA
taaacagacttactaaag

SEQ ID NO: 71637 - DNA, 18 bp, synthetic construct
  source 1..18: mol_type = other DNA
taaactgtcacactccag

SEQ ID NO: 71638 - DNA, 18 bp, synthetic construct
  source 1..18: mol_type = other DNA
taaatcaactctttatag

SEQ ID NO: 71639 - DNA, 18 bp, synthetic construct
  source 1..18: mol_type = other DNA
taaatcgacaaactaaag

SEQ ID NO: 71640 - DNA, 18 bp, synthetic construct
  source 1..18: mol_type = other DNA
taaatcgactcacagttg

SEQ ID NO: 71641 - DNA, 18 bp, synthetic construct
  source 1..18: mol_type = other DNA
taaatcgactcccttttg

SEQ ID NO: 71642 - DNA, 18 bp, synthetic construct
  source 1..18: mol_type = other DNA
taaatcgtcacacttaag

SEQ ID NO: 71643 - DNA, 18 bp, synthetic construct
  source 1..18: mol_type = other DNA
taaatcgtgtcactattg

SEQ ID NO: 71644 - DNA, 18 bp, synthetic construct
  source 1..18: mol_type = other DNA
taacacgacacattaacg

SEQ ID NO: 71645 - DNA, 18 bp, synthetic construct
  source 1..18: mol_type = other DNA
taacaggactcacatgag

SEQ ID NO: 71646 - DNA, 18 bp, synthetic construct
  source 1..18: mol_type = other DNA
taagttgtctcaccatag

SEQ ID NO: 71647 - DNA, 18 bp, synthetic construct
  source 1..18: mol_type = other DNA
taataaggcccacacttg

SEQ ID NO: 71648 - DNA, 18 bp, synthetic construct
  source 1..18: mol_type = other DNA
taataagtcagtttatag

SEQ ID NO: 71649 - DNA, 18 bp, synthetic construct
  source 1..18: mol_type = other DNA
taatacaactaccttaag

SEQ ID NO: 71650 - DNA, 18 bp, synthetic construct
  source 1..18: mol_type = other DNA
taatacaactctcattgg

SEQ ID NO: 71651 - DNA, 18 bp, synthetic construct
  source 1..18: mol_type = other DNA
taatacaacttacttatg

SEQ ID NO: 71652 - DNA, 18 bp, synthetic construct
  source 1..18: mol_type = other DNA
taatacaactttacatag

SEQ ID NO: 71653 - DNA, 18 bp, synthetic construct
  source 1..18: mol_type = other DNA
taatacaagtccatttag

SEQ ID NO: 71654 - DNA, 18 bp, synthetic construct
  source 1..18: mol_type = other DNA
taatacacctatctagag

SEQ ID NO: 71655 - DNA, 18 bp, synthetic construct
  source 1..18: mol_type = other DNA
taatacacttctctattg

SEQ ID NO: 71656 - DNA, 18 bp, synthetic construct
  source 1..18: mol_type = other DNA
taatacatccgactaatg

SEQ ID NO: 71657 - DNA, 18 bp, synthetic construct
  source 1..18: mol_type = other DNA
taatacatcttagtaaag

SEQ ID NO: 71658 - DNA, 18 bp, synthetic construct
  source 1..18: mol_type = other DNA
taatacctcgctaaatag

SEQ ID NO: 71659 - DNA, 18 bp, synthetic construct
  source 1..18: mol_type = other DNA
taatacgaatccttgctg

SEQ ID NO: 71660 - DNA, 18 bp, synthetic construct
  source 1..18: mol_type = other DNA
taatacgacttaatgatg

SEQ ID NO: 71661 - DNA, 18 bp, synthetic construct
  source 1..18: mol_type = other DNA
taatacgattttatacag

SEQ ID NO: 71662 - DNA, 18 bp, synthetic construct
  source 1..18: mol_type = other DNA
taatacgcttgactgcag

SEQ ID NO: 71663 - DNA, 18 bp, synthetic construct
  source 1..18: mol_type = other DNA
taatacgtccgagtttag

SEQ ID NO: 71664 - DNA, 18 bp, synthetic construct
  source 1..18: mol_type = other DNA
taatacgtctcataaatg

SEQ ID NO: 71665 - DNA, 18 bp, synthetic construct
  source 1..18: mol_type = other DNA
taatacgtcttacttacg

SEQ ID NO: 71666 - DNA, 18 bp, synthetic construct
  source 1..18: mol_type = other DNA
taatacgttacgctattg

SEQ ID NO: 71667 - DNA, 18 bp, synthetic construct
  source 1..18: mol_type = other DNA
taatacgtttttctattg

SEQ ID NO: 71668 - DNA, 18 bp, synthetic construct
  source 1..18: mol_type = other DNA
taatactacactatattg

SEQ ID NO: 71669 - DNA, 18 bp, synthetic construct
  source 1..18: mol_type = other DNA
taatactacttactcacg

SEQ ID NO: 71670 - DNA, 18 bp, synthetic construct
  source 1..18: mol_type = other DNA
taatacttaacacaatag

SEQ ID NO: 71671 - DNA, 18 bp, synthetic construct
  source 1..18: mol_type = other DNA
taatacttgtcaatacag

SEQ ID NO: 71672 - DNA, 18 bp, synthetic construct
  source 1..18: mol_type = other DNA
taatagacctcaccagag

SEQ ID NO: 71673 - DNA, 18 bp, synthetic construct
  source 1..18: mol_type = other DNA
taataggatttgctattg

SEQ ID NO: 71674 - DNA, 18 bp, synthetic construct
  source 1..18: mol_type = other DNA
taataggtctctttctag

SEQ ID NO: 71675 - DNA, 18 bp, synthetic construct
  source 1..18: mol_type = other DNA
taatatgaaactcttttg

SEQ ID NO: 71676 - DNA, 18 bp, synthetic construct
  source 1..18: mol_type = other DNA
taatatgactccttgaag

SEQ ID NO: 71677 - DNA, 18 bp, synthetic construct
  source 1..18: mol_type = other DNA
taatatgactcgtcatcg

SEQ ID NO: 71678 - DNA, 18 bp, synthetic construct
  source 1..18: mol_type = other DNA
taatatgtctatcaattg

SEQ ID NO: 71679 - DNA, 18 bp, synthetic construct
  source 1..18: mol_type = other DNA
taatattaccctcaatag

SEQ ID NO: 71680 - DNA, 18 bp, synthetic construct
  source 1..18: mol_type = other DNA
taatccgacaccccttag

SEQ ID NO: 71681 - DNA, 18 bp, synthetic construct
  source 1..18: mol_type = other DNA
taatccgactcatcaatg

SEQ ID NO: 71682 - DNA, 18 bp, synthetic construct
  source 1..18: mol_type = other DNA
taatccgtctagctggag

SEQ ID NO: 71683 - DNA, 18 bp, synthetic construct
  source 1..18: mol_type = other DNA
taatctgattcaaaatag

SEQ ID NO: 71684 - DNA, 18 bp, synthetic construct
  source 1..18: mol_type = other DNA
taatgcgactagctttcg

SEQ ID NO: 71685 - DNA, 18 bp, synthetic construct
  source 1..18: mol_type = other DNA
taatgcgactgctttttg

SEQ ID NO: 71686 - DNA, 18 bp, synthetic construct
  source 1..18: mol_type = other DNA
taatgcgattcaggaaag

SEQ ID NO: 71687 - DNA, 18 bp, synthetic construct
  source 1..18: mol_type = other DNA
taatgcgcctctcaacag

SEQ ID NO: 71688 - DNA, 18 bp, synthetic construct
  source 1..18: mol_type = other DNA
taattcaactctctaatg

SEQ ID NO: 71689 - DNA, 18 bp, synthetic construct
  source 1..18: mol_type = other DNA
taattcgaaccactttcg

SEQ ID NO: 71690 - DNA, 18 bp, synthetic construct
  source 1..18: mol_type = other DNA
taattcgacactttatgg

SEQ ID NO: 71691 - DNA, 18 bp, synthetic construct
  source 1..18: mol_type = other DNA
taattcgacgcttattag

SEQ ID NO: 71692 - DNA, 18 bp, synthetic construct
  source 1..18: mol_type = other DNA
taattcgatgtaatatag

SEQ ID NO: 71693 - DNA, 18 bp, synthetic construct
  source 1..18: mol_type = other DNA
taattcgtcactctgtag

SEQ ID NO: 71694 - DNA, 18 bp, synthetic construct
  source 1..18: mol_type = other DNA
taattctcctcacaagag

SEQ ID NO: 71695 - DNA, 18 bp, synthetic construct
  source 1..18: mol_type = other DNA
taattggacacattgtag

SEQ ID NO: 71696 - DNA, 18 bp, synthetic construct
  source 1..18: mol_type = other DNA
taatttgtctctctaaag

SEQ ID NO: 71697 - DNA, 18 bp, synthetic construct
  source 1..18: mol_type = other DNA
taattttacactctatag

SEQ ID NO: 71698 - DNA, 18 bp, synthetic construct
  source 1..18: mol_type = other DNA
tacatcgccacagtatag

SEQ ID NO: 71699 - DNA, 18 bp, synthetic construct
  source 1..18: mol_type = other DNA
tactactactcttataag

SEQ ID NO: 71700 - DNA, 18 bp, synthetic construct
  source 1..18: mol_type = other DNA
tactattacacactttag

SEQ ID NO: 71701 - DNA, 18 bp, synthetic construct
  source 1..18: mol_type = other DNA
tactccctctctctttag

SEQ ID NO: 71702 - DNA, 18 bp, synthetic construct
  source 1..18: mol_type = other DNA
tactcctacttcctatag

SEQ ID NO: 71703 - DNA, 18 bp, synthetic construct
  source 1..18: mol_type = other DNA
tacttaaactcaatatag

SEQ ID NO: 71704 - DNA, 18 bp, synthetic construct
  source 1..18: mol_type = other DNA
tacttcgacctaccgtag

SEQ ID NO: 71705 - DNA, 18 bp, synthetic construct
  source 1..18: mol_type = other DNA
tacttcgactctttttag

SEQ ID NO: 71706 - DNA, 18 bp, synthetic construct
  source 1..18: mol_type = other DNA
tacttctactctctttag

SEQ ID NO: 71707 - DNA, 18 bp, synthetic construct
  source 1..18: mol_type = other DNA
tagaacaactcaatttag

SEQ ID NO: 71708 - DNA, 18 bp, synthetic construct
  source 1..18: mol_type = other DNA
tagaaccaatctttacag

SEQ ID NO: 71709 - DNA, 18 bp, synthetic construct
  source 1..18: mol_type = other DNA
tagaacgtaacactaaag

SEQ ID NO: 71710 - DNA, 18 bp, synthetic construct
  source 1..18: mol_type = other DNA
tagaacgtcacactttag

SEQ ID NO: 71711 - DNA, 18 bp, synthetic construct
  source 1..18: mol_type = other DNA
tagaactcctaaattaag

SEQ ID NO: 71712 - DNA, 18 bp, synthetic construct
  source 1..18: mol_type = other DNA
tagaaggacactctatag

SEQ ID NO: 71713 - DNA, 18 bp, synthetic construct
  source 1..18: mol_type = other DNA
tagataaactcactattg

SEQ ID NO: 71714 - DNA, 18 bp, synthetic construct
  source 1..18: mol_type = other DNA
tagcacgtctatctatag

SEQ ID NO: 71715 - DNA, 18 bp, synthetic construct
  source 1..18: mol_type = other DNA
tagcacgttttacgatag

SEQ ID NO: 71716 - DNA, 18 bp, synthetic construct
  source 1..18: mol_type = other DNA
tagcataactcactaaag

SEQ ID NO: 71717 - DNA, 18 bp, synthetic construct
  source 1..18: mol_type = other DNA
tagtacgtcacaccaaag

SEQ ID NO: 71718 - DNA, 18 bp, synthetic construct
  source 1..18: mol_type = other DNA
tagtcatagttgcaatag

SEQ ID NO: 71719 - DNA, 18 bp, synthetic construct
  source 1..18: mol_type = other DNA
tagtccgtctcacattag

SEQ ID NO: 71720 - DNA, 18 bp, synthetic construct
  source 1..18: mol_type = other DNA
tagtgcgactcacttgcg

SEQ ID NO: 71721 - DNA, 18 bp, synthetic construct
  source 1..18: mol_type = other DNA
tagttctactctccatag

SEQ ID NO: 71722 - DNA, 18 bp, synthetic construct
  source 1..18: mol_type = other DNA
tataacgattcattattg

SEQ ID NO: 71723 - DNA, 18 bp, synthetic construct
  source 1..18: mol_type = other DNA
tataactcctcactacag

SEQ ID NO: 71724 - DNA, 18 bp, synthetic construct
  source 1..18: mol_type = other DNA
tataactgctcaatatag

SEQ ID NO: 71725 - DNA, 18 bp, synthetic construct
  source 1..18: mol_type = other DNA
tataccgactcaatagtg

SEQ ID NO: 71726 - DNA, 18 bp, synthetic construct
  source 1..18: mol_type = other DNA
tataccgccacactaaag

SEQ ID NO: 71727 - DNA, 18 bp, synthetic construct
  source 1..18: mol_type = other DNA
tatagcgactcagtaatg

SEQ ID NO: 71728 - DNA, 18 bp, synthetic construct
  source 1..18: mol_type = other DNA
tatatagaatcactactg

SEQ ID NO: 71729 - DNA, 18 bp, synthetic construct
  source 1..18: mol_type = other DNA
tatatccactcaatacag

SEQ ID NO: 71730 - DNA, 18 bp, synthetic construct
  source 1..18: mol_type = other DNA
tatctcaactcactatgg

SEQ ID NO: 71731 - DNA, 18 bp, synthetic construct
  source 1..18: mol_type = other DNA
tatgacgactctgttcag

SEQ ID NO: 71732 - DNA, 18 bp, synthetic construct
  source 1..18: mol_type = other DNA
tattaacactcgctttag

SEQ ID NO: 71733 - DNA, 18 bp, synthetic construct
  source 1..18: mol_type = other DNA
tattaagacttactactg

SEQ ID NO: 71734 - DNA, 18 bp, synthetic construct
  source 1..18: mol_type = other DNA
tattaagtcacaatatag

SEQ ID NO: 71735 - DNA, 18 bp, synthetic construct
  source 1..18: mol_type = other DNA
tattaagtctcaataaag

SEQ ID NO: 71736 - DNA, 18 bp, synthetic construct
  source 1..18: mol_type = other DNA
tattaagtctctctattg

SEQ ID NO: 71737 - DNA, 18 bp, synthetic construct
  source 1..18: mol_type = other DNA
tattacaacactccaatg

SEQ ID NO: 71738 - DNA, 18 bp, synthetic construct
  source 1..18: mol_type = other DNA
tattacaagtttctacag

SEQ ID NO: 71739 - DNA, 18 bp, synthetic construct
  source 1..18: mol_type = other DNA
tattacacctcattgtag

SEQ ID NO: 71740 - DNA, 18 bp, synthetic construct
  source 1..18: mol_type = other DNA
tattaccacacaacatag

SEQ ID NO: 71741 - DNA, 18 bp, synthetic construct
  source 1..18: mol_type = other DNA
tattaccattcaccaaag

SEQ ID NO: 71742 - DNA, 18 bp, synthetic construct
  source 1..18: mol_type = other DNA
tattacgactcacacatg

SEQ ID NO: 71743 - DNA, 18 bp, synthetic construct
  source 1..18: mol_type = other DNA
tattacgactcgattttg

SEQ ID NO: 71744 - DNA, 18 bp, synthetic construct
  source 1..18: mol_type = other DNA
tattacgagacgttaaag

SEQ ID NO: 71745 - DNA, 18 bp, synthetic construct
  source 1..18: mol_type = other DNA
tattacgtaactctatag

SEQ ID NO: 71746 - DNA, 18 bp, synthetic construct
  source 1..18: mol_type = other DNA
tattacgtcactatatag

SEQ ID NO: 71747 - DNA, 18 bp, synthetic construct
  source 1..18: mol_type = other DNA
tattacgtctatgtatag

SEQ ID NO: 71748 - DNA, 18 bp, synthetic construct
  source 1..18: mol_type = other DNA
tattacgtttctctttag

SEQ ID NO: 71749 - DNA, 18 bp, synthetic construct
  source 1..18: mol_type = other DNA
tattactacgaaaaatag

SEQ ID NO: 71750 - DNA, 18 bp, synthetic construct
  source 1..18: mol_type = other DNA
tattactcgtctctatgg

SEQ ID NO: 71751 - DNA, 18 bp, synthetic construct
  source 1..18: mol_type = other DNA
tattacttcacactaaag

SEQ ID NO: 71752 - DNA, 18 bp, synthetic construct
  source 1..18: mol_type = other DNA
tattatcacactcaatag

SEQ ID NO: 71753 - DNA, 18 bp, synthetic construct
  source 1..18: mol_type = other DNA
tattatgactttttatag

SEQ ID NO: 71754 - DNA, 18 bp, synthetic construct
  source 1..18: mol_type = other DNA
tattatgatacactttag

SEQ ID NO: 71755 - DNA, 18 bp, synthetic construct
  source 1..18: mol_type = other DNA
tattcagactctctttag

SEQ ID NO: 71756 - DNA, 18 bp, synthetic construct
  source 1..18: mol_type = other DNA
tattccgactcacgtttg

SEQ ID NO: 71757 - DNA, 18 bp, synthetic construct
  source 1..18: mol_type = other DNA
tattccttctctaaattg

SEQ ID NO: 71758 - DNA, 18 bp, synthetic construct
  source 1..18: mol_type = other DNA
tattgcgactctctactg

SEQ ID NO: 71759 - DNA, 18 bp, synthetic construct
  source 1..18: mol_type = other DNA
tatttagactctctttag

SEQ ID NO: 71760 - DNA, 18 bp, synthetic construct
  source 1..18: mol_type = other DNA
tatttagtcttactagtg

SEQ ID NO: 71761 - DNA, 18 bp, synthetic construct
  source 1..18: mol_type = other DNA
tatttcaaatcactcttg

SEQ ID NO: 71762 - DNA, 18 bp, synthetic construct
  source 1..18: mol_type = other DNA
tatttcgaaacgcataag

SEQ ID NO: 71763 - DNA, 18 bp, synthetic construct
  source 1..18: mol_type = other DNA
tatttcgacccattttag

SEQ ID NO: 71764 - DNA, 18 bp, synthetic construct
  source 1..18: mol_type = other DNA
tatttcgagtcacaattg

SEQ ID NO: 71765 - DNA, 18 bp, synthetic construct
  source 1..18: mol_type = other DNA
tatttcgattgacaaaag

SEQ ID NO: 71766 - DNA, 18 bp, synthetic construct
  source 1..18: mol_type = other DNA
tatttctactcaacatag

SEQ ID NO: 71767 - DNA, 18 bp, synthetic construct
  source 1..18: mol_type = other DNA
tatttctagtcacaaaag

SEQ ID NO: 71768 - DNA, 18 bp, synthetic construct
  source 1..18: mol_type = other DNA
tattttgacactccatag

SEQ ID NO: 71769 - DNA, 18 bp, synthetic construct
  source 1..18: mol_type = other DNA
tcaatcgcctcaccatag

SEQ ID NO: 71770 - DNA, 18 bp, synthetic construct
  source 1..18: mol_type = other DNA
tcataataacctgtattg

SEQ ID NO: 71771 - DNA, 18 bp, synthetic construct
  source 1..18: mol_type = other DNA
tcatacgaattacattag

SEQ ID NO: 71772 - DNA, 18 bp, synthetic construct
  source 1..18: mol_type = other DNA
tcatacgacagacattag

SEQ ID NO: 71773 - DNA, 18 bp, synthetic construct
  source 1..18: mol_type = other DNA
tcatacgtctctcataag

SEQ ID NO: 71774 - DNA, 18 bp, synthetic construct
  source 1..18: mol_type = other DNA
tcatactactaccaatag

SEQ ID NO: 71775 - DNA, 18 bp, synthetic construct
  source 1..18: mol_type = other DNA
tcatacttcgcactacag

SEQ ID NO: 71776 - DNA, 18 bp, synthetic construct
  source 1..18: mol_type = other DNA
tcatagcacacactaatg

SEQ ID NO: 71777 - DNA, 18 bp, synthetic construct
  source 1..18: mol_type = other DNA
tcatatgattcaccctag

SEQ ID NO: 71778 - DNA, 18 bp, synthetic construct
  source 1..18: mol_type = other DNA
tcatccttctccctttag

SEQ ID NO: 71779 - DNA, 18 bp, synthetic construct
  source 1..18: mol_type = other DNA
tcattcagcacactatag

SEQ ID NO: 71780 - DNA, 18 bp, synthetic construct
  source 1..18: mol_type = other DNA
tcattcgactaactactg

SEQ ID NO: 71781 - DNA, 18 bp, synthetic construct
  source 1..18: mol_type = other DNA
tcattgtactcactattg

SEQ ID NO: 71782 - DNA, 18 bp, synthetic construct
  source 1..18: mol_type = other DNA
tcctaatactcacaattg

SEQ ID NO: 71783 - DNA, 18 bp, synthetic construct
  source 1..18: mol_type = other DNA
tcctacgaatgtctatag

SEQ ID NO: 71784 - DNA, 18 bp, synthetic construct
  source 1..18: mol_type = other DNA
tcctccgactctctttag

SEQ ID NO: 71785 - DNA, 18 bp, synthetic construct
  source 1..18: mol_type = other DNA
tcgtgcgactgacaattg

SEQ ID NO: 71786 - DNA, 18 bp, synthetic construct
  source 1..18: mol_type = other DNA
tcttaccgctcactaaag

SEQ ID NO: 71787 - DNA, 18 bp, synthetic construct
  source 1..18: mol_type = other DNA
tcttaggactcacaacag

SEQ ID NO: 71788 - DNA, 18 bp, synthetic construct
  source 1..18: mol_type = other DNA
tgaaacgaaagactgtag

SEQ ID NO: 71789 - DNA, 18 bp, synthetic construct
  source 1..18: mol_type = other DNA
tgaaacgaacgactatag

SEQ ID NO: 71790 - DNA, 18 bp, synthetic construct
  source 1..18: mol_type = other DNA
tgaaacgacacagtattg

SEQ ID NO: 71791 - DNA, 18 bp, synthetic construct
  source 1..18: mol_type = other DNA
tgataagacactcttttg

SEQ ID NO: 71792 - DNA, 18 bp, synthetic construct
  source 1..18: mol_type = other DNA
tgataagagacacaaagg

SEQ ID NO: 71793 - DNA, 18 bp, synthetic construct
  source 1..18: mol_type = other DNA
tgataagcctcacaattg

SEQ ID NO: 71794 - DNA, 18 bp, synthetic construct
  source 1..18: mol_type = other DNA
tgatacaactaagtttag

SEQ ID NO: 71795 - DNA, 18 bp, synthetic construct
  source 1..18: mol_type = other DNA
tgataccaatctctattg

SEQ ID NO: 71796 - DNA, 18 bp, synthetic construct
  source 1..18: mol_type = other DNA
tgatacgacatattttgg

SEQ ID NO: 71797 - DNA, 18 bp, synthetic construct
  source 1..18: mol_type = other DNA
tgatacgtctgccaatag

SEQ ID NO: 71798 - DNA, 18 bp, synthetic construct
  source 1..18: mol_type = other DNA
tgatactactctcttatg

SEQ ID NO: 71799 - DNA, 18 bp, synthetic construct
  source 1..18: mol_type = other DNA
tgatatgtcactttgtag

SEQ ID NO: 71800 - DNA, 18 bp, synthetic construct
  source 1..18: mol_type = other DNA
tgatgcgaaccactattg

SEQ ID NO: 71801 - DNA, 18 bp, synthetic construct
  source 1..18: mol_type = other DNA
tgatgcgattcactaatg

SEQ ID NO: 71802 - DNA, 18 bp, synthetic construct
  source 1..18: mol_type = other DNA
tgattccacacactaaag

SEQ ID NO: 71803 - DNA, 18 bp, synthetic construct
  source 1..18: mol_type = other DNA
tgatttgactcacatttg

SEQ ID NO: 71804 - DNA, 18 bp, synthetic construct
  source 1..18: mol_type = other DNA
tgctacgattctttgtag

SEQ ID NO: 71805 - DNA, 18 bp, synthetic construct
  source 1..18: mol_type = other DNA
tgttaagactcaccaggg

SEQ ID NO: 71806 - DNA, 18 bp, synthetic construct
  source 1..18: mol_type = other DNA
ttaaacagctcactttag

SEQ ID NO: 71807 - DNA, 18 bp, synthetic construct
  source 1..18: mol_type = other DNA
ttaaacgaccctccatag

SEQ ID NO: 71808 - DNA, 18 bp, synthetic construct
  source 1..18: mol_type = other DNA
ttaaacgacttcctattg

SEQ ID NO: 71809 - DNA, 18 bp, synthetic construct
  source 1..18: mol_type = other DNA
ttaaacgatttattttag

SEQ ID NO: 71810 - DNA, 18 bp, synthetic construct
  source 1..18: mol_type = other DNA
ttaaacgcctctcaaaag

SEQ ID NO: 71811 - DNA, 18 bp, synthetic construct
  source 1..18: mol_type = other DNA
ttaaacgtctcactactg

SEQ ID NO: 71812 - DNA, 18 bp, synthetic construct
  source 1..18: mol_type = other DNA
ttaaactacccactattg

SEQ ID NO: 71813 - DNA, 18 bp, synthetic construct
  source 1..18: mol_type = other DNA
ttaaatgactcattttag

SEQ ID NO: 71814 - DNA, 18 bp, synthetic construct
  source 1..18: mol_type = other DNA
ttaaatgattcactttag

SEQ ID NO: 71815 - DNA, 18 bp, synthetic construct
  source 1..18: mol_type = other DNA
ttaagcgactcaaaatag

SEQ ID NO: 71816 - DNA, 18 bp, synthetic construct
  source 1..18: mol_type = other DNA
ttacaagaatcacattag

SEQ ID NO: 71817 - DNA, 18 bp, synthetic construct
  source 1..18: mol_type = other DNA
ttacacgacttactccag

SEQ ID NO: 71818 - DNA, 18 bp, synthetic construct
  source 1..18: mol_type = other DNA
ttacacgtcacattatag

SEQ ID NO: 71819 - DNA, 18 bp, synthetic construct
  source 1..18: mol_type = other DNA
ttacacgtctcacaattg

SEQ ID NO: 71820 - DNA, 18 bp, synthetic construct
  source 1..18: mol_type = other DNA
ttacactactcactcttg

SEQ ID NO: 71821 - DNA, 18 bp, synthetic construct
  source 1..18: mol_type = other DNA
ttacataattccctttgg

SEQ ID NO: 71822 - DNA, 18 bp, synthetic construct
  source 1..18: mol_type = other DNA
ttacttgaatcacgctag

SEQ ID NO: 71823 - DNA, 18 bp, synthetic construct
  source 1..18: mol_type = other DNA
ttagtagactttcaatag

SEQ ID NO: 71824 - DNA, 18 bp, synthetic construct
  source 1..18: mol_type = other DNA
ttataaaaatcagcaaag

SEQ ID NO: 71825 - DNA, 18 bp, synthetic construct
  source 1..18: mol_type = other DNA
ttatacaactcacataag

SEQ ID NO: 71826 - DNA, 18 bp, synthetic construct
  source 1..18: mol_type = other DNA
ttataccacacactaatg

SEQ ID NO: 71827 - DNA, 18 bp, synthetic construct
  source 1..18: mol_type = other DNA
ttatacctcacactagag

SEQ ID NO: 71828 - DNA, 18 bp, synthetic construct
  source 1..18: mol_type = other DNA
ttatacgaaacaataatg

SEQ ID NO: 71829 - DNA, 18 bp, synthetic construct
  source 1..18: mol_type = other DNA
ttatacgaccctatattg

SEQ ID NO: 71830 - DNA, 18 bp, synthetic construct
  source 1..18: mol_type = other DNA
ttatacgagatactatgg

SEQ ID NO: 71831 - DNA, 18 bp, synthetic construct
  source 1..18: mol_type = other DNA
ttatacgattaacttctg

SEQ ID NO: 71832 - DNA, 18 bp, synthetic construct
  source 1..18: mol_type = other DNA
ttatacgccattctatag

SEQ ID NO: 71833 - DNA, 18 bp, synthetic construct
  source 1..18: mol_type = other DNA
ttatacgcttgactcaag

SEQ ID NO: 71834 - DNA, 18 bp, synthetic construct
  source 1..18: mol_type = other DNA
ttatacgtcacacttaag

SEQ ID NO: 71835 - DNA, 18 bp, synthetic construct
  source 1..18: mol_type = other DNA
ttatacgtcacgccacag

SEQ ID NO: 71836 - DNA, 18 bp, synthetic construct
  source 1..18: mol_type = other DNA
ttatacgtctcgcttttg

SEQ ID NO: 71837 - DNA, 18 bp, synthetic construct
  source 1..18: mol_type = other DNA
ttatacgtctttcaatag

SEQ ID NO: 71838 - DNA, 18 bp, synthetic construct
  source 1..18: mol_type = other DNA
ttatacgtttaacattag

SEQ ID NO: 71839 - DNA, 18 bp, synthetic construct
  source 1..18: mol_type = other DNA
ttatactacacacattag

SEQ ID NO: 71840 - DNA, 18 bp, synthetic construct
  source 1..18: mol_type = other DNA
ttatacttctcacaattg

SEQ ID NO: 71841 - DNA, 18 bp, synthetic construct
  source 1..18: mol_type = other DNA
ttatagaattcaccatag

SEQ ID NO: 71842 - DNA, 18 bp, synthetic construct
  source 1..18: mol_type = other DNA
ttatatgtcccactatcg

SEQ ID NO: 71843 - DNA, 18 bp, synthetic construct
  source 1..18: mol_type = other DNA
ttatccgatcaactatag

SEQ ID NO: 71844 - DNA, 18 bp, synthetic construct
  source 1..18: mol_type = other DNA
ttatccgattctctttag

SEQ ID NO: 71845 - DNA, 18 bp, synthetic construct
  source 1..18: mol_type = other DNA
ttatcctactcaaaatag

SEQ ID NO: 71846 - DNA, 18 bp, synthetic construct
  source 1..18: mol_type = other DNA
ttatgcgacacattaaag

SEQ ID NO: 71847 - DNA, 18 bp, synthetic construct
  source 1..18: mol_type = other DNA
ttattaaactcaccatag

SEQ ID NO: 71848 - DNA, 18 bp, synthetic construct
  source 1..18: mol_type = other DNA
ttattagacccactttag

SEQ ID NO: 71849 - DNA, 18 bp, synthetic construct
  source 1..18: mol_type = other DNA
ttattccatcatctgtag

SEQ ID NO: 71850 - DNA, 18 bp, synthetic construct
  source 1..18: mol_type = other DNA
ttattcgacaaactctag

SEQ ID NO: 71851 - DNA, 18 bp, synthetic construct
  source 1..18: mol_type = other DNA
ttattcgacttacaatgg

SEQ ID NO: 71852 - DNA, 18 bp, synthetic construct
  source 1..18: mol_type = other DNA
ttattcgatacactacag

SEQ ID NO: 71853 - DNA, 18 bp, synthetic construct
  source 1..18: mol_type = other DNA
ttattcgattcactcttg

SEQ ID NO: 71854 - DNA, 18 bp, synthetic construct
  source 1..18: mol_type = other DNA
ttattcgcctcacaaaag

SEQ ID NO: 71855 - DNA, 18 bp, synthetic construct
  source 1..18: mol_type = other DNA
ttattcgcctcactgaag

SEQ ID NO: 71856 - DNA, 18 bp, synthetic construct
  source 1..18: mol_type = other DNA
ttattctactcacttaag

SEQ ID NO: 71857 - DNA, 18 bp, synthetic construct
  source 1..18: mol_type = other DNA
ttattctactctctagag

SEQ ID NO: 71858 - DNA, 18 bp, synthetic construct
  source 1..18: mol_type = other DNA
ttatttgactctttatag

SEQ ID NO: 71859 - DNA, 18 bp, synthetic construct
  source 1..18: mol_type = other DNA
ttcaacgactctctaaag

SEQ ID NO: 71860 - DNA, 18 bp, synthetic construct
  source 1..18: mol_type = other DNA
ttcaacgagtcactaaag

SEQ ID NO: 71861 - DNA, 18 bp, synthetic construct
  source 1..18: mol_type = other DNA
ttccgcaactcagaaaag

SEQ ID NO: 71862 - DNA, 18 bp, synthetic construct
  source 1..18: mol_type = other DNA
ttctacggttccctatgg

SEQ ID NO: 71863 - DNA, 18 bp, synthetic construct
  source 1..18: mol_type = other DNA
ttctaggactcagtattg

SEQ ID NO: 71864 - DNA, 18 bp, synthetic construct
  source 1..18: mol_type = other DNA
ttgtatgttgcactatag

SEQ ID NO: 71865 - DNA, 18 bp, synthetic construct
  source 1..18: mol_type = other DNA
ttgttcatctctttatag

SEQ ID NO: 71866 - DNA, 18 bp, synthetic construct
  source 1..18: mol_type = other DNA
tttaaggaccgactatag

SEQ ID NO: 71867 - DNA, 18 bp, synthetic construct
  source 1..18: mol_type = other DNA
tttagtgactcattaaag

SEQ ID NO: 71868 - DNA, 18 bp, synthetic construct
  source 1..18: mol_type = other DNA
tttcacgattctcgctag

SEQ ID NO: 71869 - DNA, 18 bp, synthetic construct
  source 1..18: mol_type = other DNA
ttttacgactctaaatag

SEQ ID NO: 71870 - DNA, 18 bp, synthetic construct
  source 1..18: mol_type = other DNA
ttttacgccactctattg

SEQ ID NO: 71871 - DNA, 18 bp, synthetic construct
  source 1..18: mol_type = other DNA
ttttatgacacactaaag

SEQ ID NO: 71872 - DNA, 18 bp, synthetic construct
  source 1..18: mol_type = other DNA
ttttctgactctctatag

SEQ ID NO: 71873 - DNA, 18 bp, synthetic construct
  source 1..18: mol_type = other DNA
tttttcgactcaatttag

SEQ ID NO: 71874 - DNA, 18 bp, synthetic construct
  source 1..18: mol_type = other DNA
aagaacctctcactatag

SEQ ID NO: 71875 - DNA, 18 bp, synthetic construct
  source 1..18: mol_type = other DNA
taaaacgacactcttttg

SEQ ID NO: 71876 - DNA, 18 bp, synthetic construct
  source 1..18: mol_type = other DNA
taatacgtcttacatttg

SEQ ID NO: 71877 - DNA, 18 bp, synthetic construct
  source 1..18: mol_type = other DNA
tataacgactccctcttg

SEQ ID NO: 71878 - DNA, 18 bp, synthetic construct
  source 1..18: mol_type = other DNA
tatcacgcctcacaattg

SEQ ID NO: 71879 - DNA, 18 bp, synthetic construct
  source 1..18: mol_type = other DNA
aaaaacgactccctaatg

SEQ ID NO: 71880 - DNA, 18 bp, synthetic construct
  source 1..18: mol_type = other DNA
aaaaatgactcaccatcg

SEQ ID NO: 71881 - DNA, 18 bp, synthetic construct
  source 1..18: mol_type = other DNA
aaacacaactcataaaag

SEQ ID NO: 71882 - DNA, 18 bp, synthetic construct
  source 1..18: mol_type = other DNA
aaacacgactgactccag

SEQ ID NO: 71883 - DNA, 18 bp, synthetic construct
  source 1..18: mol_type = other DNA
aaaccccacacgctaaag

SEQ ID NO: 71884 - DNA, 18 bp, synthetic construct
  source 1..18: mol_type = other DNA
aaagacgcctcactctgg

SEQ ID NO: 71885 - DNA, 18 bp, synthetic construct
  source 1..18: mol_type = other DNA
aaataacactcgctggag

SEQ ID NO: 71886 - DNA, 18 bp, synthetic construct
  source 1..18: mol_type = other DNA
aaatacaaattactttag

SEQ ID NO: 71887 - DNA, 18 bp, synthetic construct
  source 1..18: mol_type = other DNA
aaatacaactccctaatg

SEQ ID NO: 71888 - DNA, 18 bp, synthetic construct
  source 1..18: mol_type = other DNA
aaatacaactctcttttg

SEQ ID NO: 71889 - DNA, 18 bp, synthetic construct
  source 1..18: mol_type = other DNA
aaatacgactctttgaag

SEQ ID NO: 71890 - DNA, 18 bp, synthetic construct
  source 1..18: mol_type = other DNA
aaatacgcttatctctag

SEQ ID NO: 71891 - DNA, 18 bp, synthetic construct
  source 1..18: mol_type = other DNA
aaatagctcccactatag

SEQ ID NO: 71892 - DNA, 18 bp, synthetic construct
  source 1..18: mol_type = other DNA
aaatatgattcaccttag

SEQ ID NO: 71893 - DNA, 18 bp, synthetic construct
  source 1..18: mol_type = other DNA
aaatccgtaccactcttg

SEQ ID NO: 71894 - DNA, 18 bp, synthetic construct
  source 1..18: mol_type = other DNA
aaattcgatacacaatag

SEQ ID NO: 71895 - DNA, 18 bp, synthetic construct
  source 1..18: mol_type = other DNA
aaattcgtttctctaaag

SEQ ID NO: 71896 - DNA, 18 bp, synthetic construct
  source 1..18: mol_type = other DNA
aacaaagacacactatag

SEQ ID NO: 71897 - DNA, 18 bp, synthetic construct
  source 1..18: mol_type = other DNA
aacaatgcagctccaaag

SEQ ID NO: 71898 - DNA, 18 bp, synthetic construct
  source 1..18: mol_type = other DNA
aataaagactcactattg

SEQ ID NO: 71899 - DNA, 18 bp, synthetic construct
  source 1..18: mol_type = other DNA
aataagaactgaatatag

SEQ ID NO: 71900 - DNA, 18 bp, synthetic construct
  source 1..18: mol_type = other DNA
aatcaatacatacaatag

SEQ ID NO: 71901 - DNA, 18 bp, synthetic construct
  source 1..18: mol_type = other DNA
aatcacgaatcactgtag

SEQ ID NO: 71902 - DNA, 18 bp, synthetic construct
  source 1..18: mol_type = other DNA
aattaagtctcactaaag

SEQ ID NO: 71903 - DNA, 18 bp, synthetic construct
  source 1..18: mol_type = other DNA
aattacaaatcactattg

SEQ ID NO: 71904 - DNA, 18 bp, synthetic construct
  source 1..18: mol_type = other DNA
aattacgactttctattg

SEQ ID NO: 71905 - DNA, 18 bp, synthetic construct
  source 1..18: mol_type = other DNA
aattatgactctccatag

SEQ ID NO: 71906 - DNA, 18 bp, synthetic construct
  source 1..18: mol_type = other DNA
aattccgactcactaatg

SEQ ID NO: 71907 - DNA, 18 bp, synthetic construct
  source 1..18: mol_type = other DNA
acattcgactaactagtg

SEQ ID NO: 71908 - DNA, 18 bp, synthetic construct
  source 1..18: mol_type = other DNA
acattcgactcattattg

SEQ ID NO: 71909 - DNA, 18 bp, synthetic construct
  source 1..18: mol_type = other DNA
actatcgattatcttttg

SEQ ID NO: 71910 - DNA, 18 bp, synthetic construct
  source 1..18: mol_type = other DNA
actttcgactcactattg

SEQ ID NO: 71911 - DNA, 18 bp, synthetic construct
  source 1..18: mol_type = other DNA
agataggtaccaatatag

SEQ ID NO: 71912 - DNA, 18 bp, synthetic construct
  source 1..18: mol_type = other DNA
agatgctactcaatatag

SEQ ID NO: 71913 - DNA, 18 bp, synthetic construct
  source 1..18: mol_type = other DNA
ataatcgtctcacaatag

SEQ ID NO: 71914 - DNA, 18 bp, synthetic construct
  source 1..18: mol_type = other DNA
atacacgtcttattatag

SEQ ID NO: 71915 - DNA, 18 bp, synthetic construct
  source 1..18: mol_type = other DNA
atatacaactctacatag

SEQ ID NO: 71916 - DNA, 18 bp, synthetic construct
  source 1..18: mol_type = other DNA
atatacgacttacattag

SEQ ID NO: 71917 - DNA, 18 bp, synthetic construct
  source 1..18: mol_type = other DNA
atatagggttcaagattg

SEQ ID NO: 71918 - DNA, 18 bp, synthetic construct
  source 1..18: mol_type = other DNA
atatatggctcgctattg

SEQ ID NO: 71919 - DNA, 18 bp, synthetic construct
  source 1..18: mol_type = other DNA
atttacgactcactgaag

SEQ ID NO: 71920 - DNA, 18 bp, synthetic construct
  source 1..18: mol_type = other DNA
caaaacgattcacattag

SEQ ID NO: 71921 - DNA, 18 bp, synthetic construct
  source 1..18: mol_type = other DNA
caaatcgtaacacaaaag

SEQ ID NO: 71922 - DNA, 18 bp, synthetic construct
  source 1..18: mol_type = other DNA
caacatgtctctcgatag

SEQ ID NO: 71923 - DNA, 18 bp, synthetic construct
  source 1..18: mol_type = other DNA
caataagactctctaatg

SEQ ID NO: 71924 - DNA, 18 bp, synthetic construct
  source 1..18: mol_type = other DNA
caataaggcacactattg

SEQ ID NO: 71925 - DNA, 18 bp, synthetic construct
  source 1..18: mol_type = other DNA
caatacgacacgatttag

SEQ ID NO: 71926 - DNA, 18 bp, synthetic construct
  source 1..18: mol_type = other DNA
caatacgatctactatgg

SEQ ID NO: 71927 - DNA, 18 bp, synthetic construct
  source 1..18: mol_type = other DNA
caatactgctcactaatg

SEQ ID NO: 71928 - DNA, 18 bp, synthetic construct
  source 1..18: mol_type = other DNA
caatacttcatatttttg

SEQ ID NO: 71929 - DNA, 18 bp, synthetic construct
  source 1..18: mol_type = other DNA
caataggccttactaaag

SEQ ID NO: 71930 - DNA, 18 bp, synthetic construct
  source 1..18: mol_type = other DNA
caatatgctccactgtag

SEQ ID NO: 71931 - DNA, 18 bp, synthetic construct
  source 1..18: mol_type = other DNA
caattcgacgctccatag

SEQ ID NO: 71932 - DNA, 18 bp, synthetic construct
  source 1..18: mol_type = other DNA
caattcgcctcaccttag

SEQ ID NO: 71933 - DNA, 18 bp, synthetic construct
  source 1..18: mol_type = other DNA
caattcggcacactattg

SEQ ID NO: 71934 - DNA, 18 bp, synthetic construct
  source 1..18: mol_type = other DNA
caatttgacctattatag

SEQ ID NO: 71935 - DNA, 18 bp, synthetic construct
  source 1..18: mol_type = other DNA
catcaccactcactttcg

SEQ ID NO: 71936 - DNA, 18 bp, synthetic construct
  source 1..18: mol_type = other DNA
cattacgacacaatttag

SEQ ID NO: 71937 - DNA, 18 bp, synthetic construct
  source 1..18: mol_type = other DNA
cattacgactatctgtag

SEQ ID NO: 71938 - DNA, 18 bp, synthetic construct
  source 1..18: mol_type = other DNA
cattccgtgtcactaaag

SEQ ID NO: 71939 - DNA, 18 bp, synthetic construct
  source 1..18: mol_type = other DNA
cattgggattcactaatg

SEQ ID NO: 71940 - DNA, 18 bp, synthetic construct
  source 1..18: mol_type = other DNA
ccataccattctctaaag

SEQ ID NO: 71941 - DNA, 18 bp, synthetic construct
  source 1..18: mol_type = other DNA
cctctcgactcactttag

SEQ ID NO: 71942 - DNA, 18 bp, synthetic construct
  source 1..18: mol_type = other DNA
ctataagtttaacaatag

SEQ ID NO: 71943 - DNA, 18 bp, synthetic construct
  source 1..18: mol_type = other DNA
ctatacgtcacactattg

SEQ ID NO: 71944 - DNA, 18 bp, synthetic construct
  source 1..18: mol_type = other DNA
ctatatgactcgctttag

SEQ ID NO: 71945 - DNA, 18 bp, synthetic construct
  source 1..18: mol_type = other DNA
ctattcgattcactatgg

SEQ ID NO: 71946 - DNA, 18 bp, synthetic construct
  source 1..18: mol_type = other DNA
ctattctactcactattg

SEQ ID NO: 71947 - DNA, 18 bp, synthetic construct
  source 1..18: mol_type = other DNA
ctcagctaatcaaagtag

SEQ ID NO: 71948 - DNA, 18 bp, synthetic construct
  source 1..18: mol_type = other DNA
ctgtacgattcactacag

SEQ ID NO: 71949 - DNA, 18 bp, synthetic construct
  source 1..18: mol_type = other DNA
ctttacgacttactttag

SEQ ID NO: 71950 - DNA, 18 bp, synthetic construct
  source 1..18: mol_type = other DNA
gaacccgtctcactattg

SEQ ID NO: 71951 - DNA, 18 bp, synthetic construct
  source 1..18: mol_type = other DNA
gaataagaatcattaaag

SEQ ID NO: 71952 - DNA, 18 bp, synthetic construct
  source 1..18: mol_type = other DNA
gaatacgacactttctcg

SEQ ID NO: 71953 - DNA, 18 bp, synthetic construct
  source 1..18: mol_type = other DNA
gattacggctcacaattg

SEQ ID NO: 71954 - DNA, 18 bp, synthetic construct
  source 1..18: mol_type = other DNA
gcatttgtctcactatag

SEQ ID NO: 71955 - DNA, 18 bp, synthetic construct
  source 1..18: mol_type = other DNA
gtaaacgtctccctatag

SEQ ID NO: 71956 - DNA, 18 bp, synthetic construct
  source 1..18: mol_type = other DNA
gtacacgattcaataaag

SEQ ID NO: 71957 - DNA, 18 bp, synthetic construct
  source 1..18: mol_type = other DNA
gtataattcacaatatag

SEQ ID NO: 71958 - DNA, 18 bp, synthetic construct
  source 1..18: mol_type = other DNA
taaaaacactttaaacag

SEQ ID NO: 71959 - DNA, 18 bp, synthetic construct
  source 1..18: mol_type = other DNA
taaaacaactcaacatgg

SEQ ID NO: 71960 - DNA, 18 bp, synthetic construct
  source 1..18: mol_type = other DNA
taaaacagctcacttctg

SEQ ID NO: 71961 - DNA, 18 bp, synthetic construct
  source 1..18: mol_type = other DNA
taaaacgactgattcatg

SEQ ID NO: 71962 - DNA, 18 bp, synthetic construct
  source 1..18: mol_type = other DNA
taaaacgatactcaatag

SEQ ID NO: 71963 - DNA, 18 bp, synthetic construct
  source 1..18: mol_type = other DNA
taaaacgccactcttttg

SEQ ID NO: 71964 - DNA, 18 bp, synthetic construct
  source 1..18: mol_type = other DNA
taaaacggtgtagtatag

SEQ ID NO: 71965 - DNA, 18 bp, synthetic construct
  source 1..18: mol_type = other DNA
taaaacgtctctctctgg

SEQ ID NO: 71966 - DNA, 18 bp, synthetic construct
  source 1..18: mol_type = other DNA
taaaacgtgtatctatag

SEQ ID NO: 71967 - DNA, 18 bp, synthetic construct
  source 1..18: mol_type = other DNA
taaaactcttcattatag

SEQ ID NO: 71968 - DNA, 18 bp, synthetic construct
  source 1..18: mol_type = other DNA
taaaaggatacacaattg

SEQ ID NO: 71969 - DNA, 18 bp, synthetic construct
  source 1..18: mol_type = other DNA
taaaatgactcacatacg

SEQ ID NO: 71970 - DNA, 18 bp, synthetic construct
  source 1..18: mol_type = other DNA
taaaattacacagtttaa

SEQ ID NO: 71971 - DNA, 18 bp, synthetic construct
  source 1..18: mol_type = other DNA
taaagcaacatactctgg

SEQ ID NO: 71972 - DNA, 18 bp, synthetic construct
  source 1..18: mol_type = other DNA
taaatcgactctatatgg

SEQ ID NO: 71973 - DNA, 18 bp, synthetic construct
  source 1..18: mol_type = other DNA
taaatctaattactatag

SEQ ID NO: 71974 - DNA, 18 bp, synthetic construct
  source 1..18: mol_type = other DNA
taacaccaaacaatatag

SEQ ID NO: 71975 - DNA, 18 bp, synthetic construct
  source 1..18: mol_type = other DNA
taacacgactacacatag

SEQ ID NO: 71976 - DNA, 18 bp, synthetic construct
  source 1..18: mol_type = other DNA
taacacgtttgactttag

SEQ ID NO: 71977 - DNA, 18 bp, synthetic construct
  source 1..18: mol_type = other DNA
taactcgccatgggaacg

SEQ ID NO: 71978 - DNA, 18 bp, synthetic construct
  source 1..18: mol_type = other DNA
taactcgtttcactattg

SEQ ID NO: 71979 - DNA, 18 bp, synthetic construct
  source 1..18: mol_type = other DNA
taacttgactaactttag

SEQ ID NO: 71980 - DNA, 18 bp, synthetic construct
  source 1..18: mol_type = other DNA
taagacgatacccaatag

SEQ ID NO: 71981 - DNA, 18 bp, synthetic construct
  source 1..18: mol_type = other DNA
taataaaccaaactaagg

SEQ ID NO: 71982 - DNA, 18 bp, synthetic construct
  source 1..18: mol_type = other DNA
taataacatcctaaatag

SEQ ID NO: 71983 - DNA, 18 bp, synthetic construct
  source 1..18: mol_type = other DNA
taataagtgtctctattg

SEQ ID NO: 71984 - DNA, 18 bp, synthetic construct
  source 1..18: mol_type = other DNA
taataagtgttactatgg

SEQ ID NO: 71985 - DNA, 18 bp, synthetic construct
  source 1..18: mol_type = other DNA
taataagtttgtttatag

SEQ ID NO: 71986 - DNA, 18 bp, synthetic construct
  source 1..18: mol_type = other DNA
taatacaactcccatttg

SEQ ID NO: 71987 - DNA, 18 bp, synthetic construct
  source 1..18: mol_type = other DNA
taatacaactgtctaatg

SEQ ID NO: 71988 - DNA, 18 bp, synthetic construct
  source 1..18: mol_type = other DNA
taatacaattcattactg

SEQ ID NO: 71989 - DNA, 18 bp, synthetic construct
  source 1..18: mol_type = other DNA
taatacccctcactcatg

SEQ ID NO: 71990 - DNA, 18 bp, synthetic construct
  source 1..18: mol_type = other DNA
taatacccctcagttaag

SEQ ID NO: 71991 - DNA, 18 bp, synthetic construct
  source 1..18: mol_type = other DNA
taatacctctatctaaag

SEQ ID NO: 71992 - DNA, 18 bp, synthetic construct
  source 1..18: mol_type = other DNA
taatacgacacatactgg

SEQ ID NO: 71993 - DNA, 18 bp, synthetic construct
  source 1..18: mol_type = other DNA
taatacgacacatcaatg

SEQ ID NO: 71994 - DNA, 18 bp, synthetic construct
  source 1..18: mol_type = other DNA
taatacgacacccttctg

SEQ ID NO: 71995 - DNA, 18 bp, synthetic construct
  source 1..18: mol_type = other DNA
taatacgacgttatttag

SEQ ID NO: 71996 - DNA, 18 bp, synthetic construct
  source 1..18: mol_type = other DNA
taatacgactcaaatagg

SEQ ID NO: 71997 - DNA, 18 bp, synthetic construct
  source 1..18: mol_type = other DNA
taatacgagttattcaag

SEQ ID NO: 71998 - DNA, 18 bp, synthetic construct
  source 1..18: mol_type = other DNA
taatacgcatctcattag

SEQ ID NO: 71999 - DNA, 18 bp, synthetic construct
  source 1..18: mol_type = other DNA
taatacggcattctttag

SEQ ID NO: 72000 - DNA, 18 bp, synthetic construct
  source 1..18: mol_type = other DNA
taatacggctcagattcg

SEQ ID NO: 72001 - DNA, 18 bp, synthetic construct
  source 1..18: mol_type = other DNA
taatacgtcaaactaagg

SEQ ID NO: 72002 - DNA, 18 bp, synthetic construct
  source 1..18: mol_type = other DNA
taatacgtcagtctaaag

SEQ ID NO: 72003 - DNA, 18 bp, synthetic construct
  source 1..18: mol_type = other DNA
taatacgtctcacatgtg

SEQ ID NO: 72004 - DNA, 18 bp, synthetic construct
  source 1..18: mol_type = other DNA
taatacgtctccccaaaa

SEQ ID NO: 72005 - DNA, 18 bp, synthetic construct
  source 1..18: mol_type = other DNA
taatacgtcttatttaag

SEQ ID NO: 72006 - DNA, 18 bp, synthetic construct
  source 1..18: mol_type = other DNA
taatacgttaaaccatag

SEQ ID NO: 72007 - DNA, 18 bp, synthetic construct
  source 1..18: mol_type = other DNA
taatacgttagagtaaag

SEQ ID NO: 72008 - DNA, 18 bp, synthetic construct
  source 1..18: mol_type = other DNA
taatactacactcttttg

SEQ ID NO: 72009 - DNA, 18 bp, synthetic construct
  source 1..18: mol_type = other DNA
taatactatacacaaaag

SEQ ID NO: 72010 - DNA, 18 bp, synthetic construct
  source 1..18: mol_type = other DNA
taatacttctctcttttg

SEQ ID NO: 72011 - DNA, 18 bp, synthetic construct
  source 1..18: mol_type = other DNA
taataggacacacattcg

SEQ ID NO: 72012 - DNA, 18 bp, synthetic construct
  source 1..18: mol_type = other DNA
taataggactctattaag

SEQ ID NO: 72013 - DNA, 18 bp, synthetic construct
  source 1..18: mol_type = other DNA
taatataactcacatttg

SEQ ID NO: 72014 - DNA, 18 bp, synthetic construct
  source 1..18: mol_type = other DNA
taatatgactaacttatg

SEQ ID NO: 72015 - DNA, 18 bp, synthetic construct
  source 1..18: mol_type = other DNA
taatatggctaactctcg

SEQ ID NO: 72016 - DNA, 18 bp, synthetic construct
  source 1..18: mol_type = other DNA
taatatgtctcacttatg

SEQ ID NO: 72017 - DNA, 18 bp, synthetic construct
  source 1..18: mol_type = other DNA
taatcagactctttttag

SEQ ID NO: 72018 - DNA, 18 bp, synthetic construct
  source 1..18: mol_type = other DNA
taatcctacgcacttaag

SEQ ID NO: 72019 - DNA, 18 bp, synthetic construct
  source 1..18: mol_type = other DNA
taatcctattaacaatag

SEQ ID NO: 72020 - DNA, 18 bp, synthetic construct
  source 1..18: mol_type = other DNA
taatctgaatcaccttag

SEQ ID NO: 72021 - DNA, 18 bp, synthetic construct
  source 1..18: mol_type = other DNA
taatgattatttcaaatg

SEQ ID NO: 72022 - DNA, 18 bp, synthetic construct
  source 1..18: mol_type = other DNA
taatgcaactcgcattag

SEQ ID NO: 72023 - DNA, 18 bp, synthetic construct
  source 1..18: mol_type = other DNA
taatgcgactgaatcaag

SEQ ID NO: 72024 - DNA, 18 bp, synthetic construct
  source 1..18: mol_type = other DNA
taatgcgtaaccctatag

SEQ ID NO: 72025 - DNA, 18 bp, synthetic construct
  source 1..18: mol_type = other DNA
taatgcgttccattatag

SEQ ID NO: 72026 - DNA, 18 bp, synthetic construct
  source 1..18: mol_type = other DNA
taattaaaatttcttttg

SEQ ID NO: 72027 - DNA, 18 bp, synthetic construct
  source 1..18: mol_type = other DNA
taattactctcagtatag

SEQ ID NO: 72028 - DNA, 18 bp, synthetic construct
  source 1..18: mol_type = other DNA
taattagacacgctaaag

SEQ ID NO: 72029 - DNA, 18 bp, synthetic construct
  source 1..18: mol_type = other DNA
taattagcctcgatcatg

SEQ ID NO: 72030 - DNA, 18 bp, synthetic construct
  source 1..18: mol_type = other DNA
taattattctcactaaag

SEQ ID NO: 72031 - DNA, 18 bp, synthetic construct
  source 1..18: mol_type = other DNA
taattcatcttactaaag

SEQ ID NO: 72032 - DNA, 18 bp, synthetic construct
  source 1..18: mol_type = other DNA
taattcatcttagtctag

SEQ ID NO: 72033 - DNA, 18 bp, synthetic construct
  source 1..18: mol_type = other DNA
taattcctctcctttaag

SEQ ID NO: 72034 - DNA, 18 bp, synthetic construct
  source 1..18: mol_type = other DNA
taattcgaccatcattag

SEQ ID NO: 72035 - DNA, 18 bp, synthetic construct
  source 1..18: mol_type = other DNA
taattcgacgcttttttg

SEQ ID NO: 72036 - DNA, 18 bp, synthetic construct
  source 1..18: mol_type = other DNA
taattcgtcaaacatttg

SEQ ID NO: 72037 - DNA, 18 bp, synthetic construct
  source 1..18: mol_type = other DNA
taattcgtctcactgagg

SEQ ID NO: 72038 - DNA, 18 bp, synthetic construct
  source 1..18: mol_type = other DNA
taattctactaattaaag

SEQ ID NO: 72039 - DNA, 18 bp, synthetic construct
  source 1..18: mol_type = other DNA
taattggactcgcttaag

SEQ ID NO: 72040 - DNA, 18 bp, synthetic construct
  source 1..18: mol_type = other DNA
tacaacgacacattttag

SEQ ID NO: 72041 - DNA, 18 bp, synthetic construct
  source 1..18: mol_type = other DNA
tacaattactaacaattg

SEQ ID NO: 72042 - DNA, 18 bp, synthetic construct
  source 1..18: mol_type = other DNA
tacacggtcttaaaatag

SEQ ID NO: 72043 - DNA, 18 bp, synthetic construct
  source 1..18: mol_type = other DNA
taccacaacacactattg

SEQ ID NO: 72044 - DNA, 18 bp, synthetic construct
  source 1..18: mol_type = other DNA
taccacgaatcacttttg

SEQ ID NO: 72045 - DNA, 18 bp, synthetic construct
  source 1..18: mol_type = other DNA
tactaagactctataagg

SEQ ID NO: 72046 - DNA, 18 bp, synthetic construct
  source 1..18: mol_type = other DNA
tactacgactctgaattg

SEQ ID NO: 72047 - DNA, 18 bp, synthetic construct
  source 1..18: mol_type = other DNA
tactactacacattacag

SEQ ID NO: 72048 - DNA, 18 bp, synthetic construct
  source 1..18: mol_type = other DNA
tactcccatccactatgg

SEQ ID NO: 72049 - DNA, 18 bp, synthetic construct
  source 1..18: mol_type = other DNA
tacttcaagtcagtttag

SEQ ID NO: 72050 - DNA, 18 bp, synthetic construct
  source 1..18: mol_type = other DNA
tagaacgtctcattattg

SEQ ID NO: 72051 - DNA, 18 bp, synthetic construct
  source 1..18: mol_type = other DNA
tagaactacttactattg

SEQ ID NO: 72052 - DNA, 18 bp, synthetic construct
  source 1..18: mol_type = other DNA
tagcacatctcactaaag

SEQ ID NO: 72053 - DNA, 18 bp, synthetic construct
  source 1..18: mol_type = other DNA
tagcacgtcatactatag

SEQ ID NO: 72054 - DNA, 18 bp, synthetic construct
  source 1..18: mol_type = other DNA
tagtaacgcatacaatgg

SEQ ID NO: 72055 - DNA, 18 bp, synthetic construct
  source 1..18: mol_type = other DNA
tagtacgtcaccctttag

SEQ ID NO: 72056 - DNA, 18 bp, synthetic construct
  source 1..18: mol_type = other DNA
tagtacgtctctcttacg

SEQ ID NO: 72057 - DNA, 18 bp, synthetic construct
  source 1..18: mol_type = other DNA
tagtactacacataattg

SEQ ID NO: 72058 - DNA, 18 bp, synthetic construct
  source 1..18: mol_type = other DNA
tagtatggatcactctag

SEQ ID NO: 72059 - DNA, 18 bp, synthetic construct
  source 1..18: mol_type = other DNA
tagtattactcacttttg

SEQ ID NO: 72060 - DNA, 18 bp, synthetic construct
  source 1..18: mol_type = other DNA
tataacaactctctatcg

SEQ ID NO: 72061 - DNA, 18 bp, synthetic construct
  source 1..18: mol_type = other DNA
tataacgaaacactctag

SEQ ID NO: 72062 - DNA, 18 bp, synthetic construct
  source 1..18: mol_type = other DNA
tataacgacactctgtag

SEQ ID NO: 72063 - DNA, 18 bp, synthetic construct
  source 1..18: mol_type = other DNA
tataacgaccaacaatag

SEQ ID NO: 72064 - DNA, 18 bp, synthetic construct
  source 1..18: mol_type = other DNA
tataacgactttatatag

SEQ ID NO: 72065 - DNA, 18 bp, synthetic construct
  source 1..18: mol_type = other DNA
tataacgcgtcattatag

SEQ ID NO: 72066 - DNA, 18 bp, synthetic construct
  source 1..18: mol_type = other DNA
tataatgactctctctag

SEQ ID NO: 72067 - DNA, 18 bp, synthetic construct
  source 1..18: mol_type = other DNA
tatagcaactcaccactg

SEQ ID NO: 72068 - DNA, 18 bp, synthetic construct
  source 1..18: mol_type = other DNA
tatatcgacacacaatag

SEQ ID NO: 72069 - DNA, 18 bp, synthetic construct
  source 1..18: mol_type = other DNA
tatatcgactgactcaag

SEQ ID NO: 72070 - DNA, 18 bp, synthetic construct
  source 1..18: mol_type = other DNA
tatcactattagctatag

SEQ ID NO: 72071 - DNA, 18 bp, synthetic construct
  source 1..18: mol_type = other DNA
tatcccgagagacaagtg

SEQ ID NO: 72072 - DNA, 18 bp, synthetic construct
  source 1..18: mol_type = other DNA
tatgacttctcacaatag

SEQ ID NO: 72073 - DNA, 18 bp, synthetic construct
  source 1..18: mol_type = other DNA
tattaagactttcaatag

SEQ ID NO: 72074 - DNA, 18 bp, synthetic construct
  source 1..18: mol_type = other DNA
tattacaacacactaatg

SEQ ID NO: 72075 - DNA, 18 bp, synthetic construct
  source 1..18: mol_type = other DNA
tattacacctcactgaag

SEQ ID NO: 72076 - DNA, 18 bp, synthetic construct
  source 1..18: mol_type = other DNA
tattaccacccattattg

SEQ ID NO: 72077 - DNA, 18 bp, synthetic construct
  source 1..18: mol_type = other DNA
tattacctcttactaaag

SEQ ID NO: 72078 - DNA, 18 bp, synthetic construct
  source 1..18: mol_type = other DNA
tattacgaaccacagtag

SEQ ID NO: 72079 - DNA, 18 bp, synthetic construct
  source 1..18: mol_type = other DNA
tattacgacccatttttg

SEQ ID NO: 72080 - DNA, 18 bp, synthetic construct
  source 1..18: mol_type = other DNA
tattacgactcaacaatg

SEQ ID NO: 72081 - DNA, 18 bp, synthetic construct
  source 1..18: mol_type = other DNA
tattacgactctgtctcg

SEQ ID NO: 72082 - DNA, 18 bp, synthetic construct
  source 1..18: mol_type = other DNA
tattacgactgtcttctg

SEQ ID NO: 72083 - DNA, 18 bp, synthetic construct
  source 1..18: mol_type = other DNA
tattacgattctctaatg

SEQ ID NO: 72084 - DNA, 18 bp, synthetic construct
  source 1..18: mol_type = other DNA
tattacgtataacaatag

SEQ ID NO: 72085 - DNA, 18 bp, synthetic construct
  source 1..18: mol_type = other DNA
tattacgtatctgtaaag

SEQ ID NO: 72086 - DNA, 18 bp, synthetic construct
  source 1..18: mol_type = other DNA
tattacgtttcggtatag

SEQ ID NO: 72087 - DNA, 18 bp, synthetic construct
  source 1..18: mol_type = other DNA
tattacgtttctcattcg

SEQ ID NO: 72088 - DNA, 18 bp, synthetic construct
  source 1..18: mol_type = other DNA
tattactaatcactgaag

SEQ ID NO: 72089 - DNA, 18 bp, synthetic construct
  source 1..18: mol_type = other DNA
tattactactcactcctg

SEQ ID NO: 72090 - DNA, 18 bp, synthetic construct
  source 1..18: mol_type = other DNA
tattaggactccgtattg

SEQ ID NO: 72091 - DNA, 18 bp, synthetic construct
  source 1..18: mol_type = other DNA
tattatgatgctcaatag

SEQ ID NO: 72092 - DNA, 18 bp, synthetic construct
  source 1..18: mol_type = other DNA
tattcatacttgctgttg

SEQ ID NO: 72093 - DNA, 18 bp, synthetic construct
  source 1..18: mol_type = other DNA
tattccgattccatatag

SEQ ID NO: 72094 - DNA, 18 bp, synthetic construct
  source 1..18: mol_type = other DNA
tattgcttctctctatag

SEQ ID NO: 72095 - DNA, 18 bp, synthetic construct
  source 1..18: mol_type = other DNA
tattgttactatatattg

SEQ ID NO: 72096 - DNA, 18 bp, synthetic construct
  source 1..18: mol_type = other DNA
tatttcgactaagtcaag

SEQ ID NO: 72097 - DNA, 18 bp, synthetic construct
  source 1..18: mol_type = other DNA
tatttcgactcccaaaag

SEQ ID NO: 72098 - DNA, 18 bp, synthetic construct
  source 1..18: mol_type = other DNA
tcatacgactaaacgtag

SEQ ID NO: 72099 - DNA, 18 bp, synthetic construct
  source 1..18: mol_type = other DNA
tcatacgtcatcctatag

SEQ ID NO: 72100 - DNA, 18 bp, synthetic construct
  source 1..18: mol_type = other DNA
tcattcgactctcttaag

SEQ ID NO: 72101 - DNA, 18 bp, synthetic construct
  source 1..18: mol_type = other DNA
tcattcgtctcaatttag

SEQ ID NO: 72102 - DNA, 18 bp, synthetic construct
  source 1..18: mol_type = other DNA
tccttcgtttcactcttg

SEQ ID NO: 72103 - DNA, 18 bp, synthetic construct
  source 1..18: mol_type = other DNA
tctgtcgtctcgcgattg

SEQ ID NO: 72104 - DNA, 18 bp, synthetic construct
  source 1..18: mol_type = other DNA
tgacttgactcattatag

SEQ ID NO: 72105 - DNA, 18 bp, synthetic construct
  source 1..18: mol_type = other DNA
tgatacttcacacttaag

SEQ ID NO: 72106 - DNA, 18 bp, synthetic construct
  source 1..18: mol_type = other DNA
tgatatgtcactcaatag

SEQ ID NO: 72107 - DNA, 18 bp, synthetic construct
  source 1..18: mol_type = other DNA
tgattatacaaactattg

SEQ ID NO: 72108 - DNA, 18 bp, synthetic construct
  source 1..18: mol_type = other DNA
tgattcgaatcattatgg

SEQ ID NO: 72109 - DNA, 18 bp, synthetic construct
  source 1..18: mol_type = other DNA
tgattcgacacacaaaag

SEQ ID NO: 72110 - DNA, 18 bp, synthetic construct
  source 1..18: mol_type = other DNA
tgattcgcctcacaattg

SEQ ID NO: 72111 - DNA, 18 bp, synthetic construct
  source 1..18: mol_type = other DNA
tgatttgattctctatag

SEQ ID NO: 72112 - DNA, 18 bp, synthetic construct
  source 1..18: mol_type = other DNA
tggtgcgagtctttatag

SEQ ID NO: 72113 - DNA, 18 bp, synthetic construct
  source 1..18: mol_type = other DNA
tgtaacgaatctctatag

SEQ ID NO: 72114 - DNA, 18 bp, synthetic construct
  source 1..18: mol_type = other DNA
tgttaagacatactttag

SEQ ID NO: 72115 - DNA, 18 bp, synthetic construct
  source 1..18: mol_type = other DNA
ttaaaagtttcactaaag

SEQ ID NO: 72116 - DNA, 18 bp, synthetic construct
  source 1..18: mol_type = other DNA
ttaaacaattaactttag

SEQ ID NO: 72117 - DNA, 18 bp, synthetic construct
  source 1..18: mol_type = other DNA
ttaaacttctcacccttg

SEQ ID NO: 72118 - DNA, 18 bp, synthetic construct
  source 1..18: mol_type = other DNA
ttaaccgtctcactatgg

SEQ ID NO: 72119 - DNA, 18 bp, synthetic construct
  source 1..18: mol_type = other DNA
ttaagcgactcacatttg

SEQ ID NO: 72120 - DNA, 18 bp, synthetic construct
  source 1..18: mol_type = other DNA
ttaatccagatactatgg

SEQ ID NO: 72121 - DNA, 18 bp, synthetic construct
  source 1..18: mol_type = other DNA
ttaatcgaatcactatcg

SEQ ID NO: 72122 - DNA, 18 bp, synthetic construct
  source 1..18: mol_type = other DNA
ttaatcgtctcgttaaag

SEQ ID NO: 72123 - DNA, 18 bp, synthetic construct
  source 1..18: mol_type = other DNA
ttacacgtctcacttcag

SEQ ID NO: 72124 - DNA, 18 bp, synthetic construct
  source 1..18: mol_type = other DNA
ttaccctagtcactctag

SEQ ID NO: 72125 - DNA, 18 bp, synthetic construct
  source 1..18: mol_type = other DNA
ttactctacgcactttag

SEQ ID NO: 72126 - DNA, 18 bp, synthetic construct
  source 1..18: mol_type = other DNA
ttataacagtcattatag

SEQ ID NO: 72127 - DNA, 18 bp, synthetic construct
  source 1..18: mol_type = other DNA
ttataagacacaaaatag

SEQ ID NO: 72128 - DNA, 18 bp, synthetic construct
  source 1..18: mol_type = other DNA
ttataagacttgctattg

SEQ ID NO: 72129 - DNA, 18 bp, synthetic construct
  source 1..18: mol_type = other DNA
ttataagtcactctatag

SEQ ID NO: 72130 - DNA, 18 bp, synthetic construct
  source 1..18: mol_type = other DNA
ttataagtctcactaatg

SEQ ID NO: 72131 - DNA, 18 bp, synthetic construct
  source 1..18: mol_type = other DNA
ttataccactgcctttag

SEQ ID NO: 72132 - DNA, 18 bp, synthetic construct
  source 1..18: mol_type = other DNA
ttatacgaaactctttag

SEQ ID NO: 72133 - DNA, 18 bp, synthetic construct
  source 1..18: mol_type = other DNA
ttatacgtaacataagag

SEQ ID NO: 72134 - DNA, 18 bp, synthetic construct
  source 1..18: mol_type = other DNA
ttatactactcgctttcg

SEQ ID NO: 72135 - DNA, 18 bp, synthetic construct
  source 1..18: mol_type = other DNA
ttatactacttacaacag

SEQ ID NO: 72136 - DNA, 18 bp, synthetic construct
  source 1..18: mol_type = other DNA
ttatatcacgcaccatag

SEQ ID NO: 72137 - DNA, 18 bp, synthetic construct
  source 1..18: mol_type = other DNA
ttatatcatttattttag

SEQ ID NO: 72138 - DNA, 18 bp, synthetic construct
  source 1..18: mol_type = other DNA
ttatcccactcacttcag

SEQ ID NO: 72139 - DNA, 18 bp, synthetic construct
  source 1..18: mol_type = other DNA
ttatccgacacgctacgg

SEQ ID NO: 72140 - DNA, 18 bp, synthetic construct
  source 1..18: mol_type = other DNA
ttatccgacccgcaatag

SEQ ID NO: 72141 - DNA, 18 bp, synthetic construct
  source 1..18: mol_type = other DNA
ttatccgactcttacaag

SEQ ID NO: 72142 - DNA, 18 bp, synthetic construct
  source 1..18: mol_type = other DNA
ttatccgccttacaatag

SEQ ID NO: 72143 - DNA, 18 bp, synthetic construct
  source 1..18: mol_type = other DNA
ttatgagacccgttatag

SEQ ID NO: 72144 - DNA, 18 bp, synthetic construct
  source 1..18: mol_type = other DNA
ttatgctaccccctcttg

SEQ ID NO: 72145 - DNA, 18 bp, synthetic construct
  source 1..18: mol_type = other DNA
ttattcaaatctctatag

SEQ ID NO: 72146 - DNA, 18 bp, synthetic construct
  source 1..18: mol_type = other DNA
ttattcaactatctaatg

SEQ ID NO: 72147 - DNA, 18 bp, synthetic construct
  source 1..18: mol_type = other DNA
ttattcctctcactatcg

SEQ ID NO: 72148 - DNA, 18 bp, synthetic construct
  source 1..18: mol_type = other DNA
ttattcgcgtcacttgag

SEQ ID NO: 72149 - DNA, 18 bp, synthetic construct
  source 1..18: mol_type = other DNA
ttattcggctcttattag

SEQ ID NO: 72150 - DNA, 18 bp, synthetic construct
  source 1..18: mol_type = other DNA
ttattcgtccaagtgtcg

SEQ ID NO: 72151 - DNA, 18 bp, synthetic construct
  source 1..18: mol_type = other DNA
ttatttgacccagattgg

SEQ ID NO: 72152 - DNA, 18 bp, synthetic construct
  source 1..18: mol_type = other DNA
ttcattcactcacaatag

SEQ ID NO: 72153 - DNA, 18 bp, synthetic construct
  source 1..18: mol_type = other DNA
ttccatgacttactattg

SEQ ID NO: 72154 - DNA, 18 bp, synthetic construct
  source 1..18: mol_type = other DNA
ttctagcacgcactatag

SEQ ID NO: 72155 - DNA, 18 bp, synthetic construct
  source 1..18: mol_type = other DNA
ttctaggactcaataaag

SEQ ID NO: 72156 - DNA, 18 bp, synthetic construct
  source 1..18: mol_type = other DNA
ttgtaagactgtttatcg

SEQ ID NO: 72157 - DNA, 18 bp, synthetic construct
  source 1..18: mol_type = other DNA
ttgtatgattctctccag

SEQ ID NO: 72158 - DNA, 18 bp, synthetic construct
  source 1..18: mol_type = other DNA
tttaatttctcaaaatag

SEQ ID NO: 72159 - DNA, 18 bp, synthetic construct
  source 1..18: mol_type = other DNA
tttattcaatcactatag

SEQ ID NO: 72160 - DNA, 18 bp, synthetic construct
  source 1..18: mol_type = other DNA
tttcacgactcacattgg

SEQ ID NO: 72161 - DNA, 18 bp, synthetic construct
  source 1..18: mol_type = other DNA
tttcacgactcacttttg

SEQ ID NO: 72162 - DNA, 18 bp, synthetic construct
  source 1..18: mol_type = other DNA
tttgacgtctaactatag

SEQ ID NO: 72163 - DNA, 18 bp, synthetic construct
  source 1..18: mol_type = other DNA
ttttaagcctctctatag

SEQ ID NO: 72164 - DNA, 18 bp, synthetic construct
  source 1..18: mol_type = other DNA
ttttacatctcagtatag

SEQ ID NO: 72165 - DNA, 18 bp, synthetic construct
  source 1..18: mol_type = other DNA
ttttacgtctcattaaag

SEQ ID NO: 72166 - DNA, 18 bp, synthetic construct
  source 1..18: mol_type = other DNA
ttttatgactttctatag

SEQ ID NO: 72167 - DNA, 18 bp, synthetic construct
  source 1..18: mol_type = other DNA
tttttcgacttattatag

SEQ ID NO: 72168 - DNA, 18 bp, synthetic construct
  source 1..18: mol_type = other DNA
tttttcgagacactatag

SEQ ID NO: 72169 - DNA, 18 bp, synthetic construct
  source 1..18: mol_type = other DNA
ttataccgctcaatctag

SEQ ID NO: 72170 - DNA, 18 bp, synthetic construct
  source 1..18: mol_type = other DNA
ttattcgattctctattg

SEQ ID NO: 72171 - DNA, 18 bp, synthetic construct
  source 1..18: mol_type = other DNA
aaaaacgaatcacattag

SEQ ID NO: 72172 - DNA, 18 bp, synthetic construct
  source 1..18: mol_type = other DNA
aaaaacgactgtatattg

SEQ ID NO: 72173 - DNA, 18 bp, synthetic construct
  source 1..18: mol_type = other DNA
aaaatcgaatcacaatgg

SEQ ID NO: 72174 - DNA, 18 bp, synthetic construct
  source 1..18: mol_type = other DNA
aaaatttactctctatag

SEQ ID NO: 72175 - DNA, 18 bp, synthetic construct
  source 1..18: mol_type = other DNA
aaacacgactcccttgag

SEQ ID NO: 72176 - DNA, 18 bp, synthetic construct
  source 1..18: mol_type = other DNA
aaacgccactcactattg

SEQ ID NO: 72177 - DNA, 18 bp, synthetic construct
  source 1..18: mol_type = other DNA
aaactcatcccactattg

SEQ ID NO: 72178 - DNA, 18 bp, synthetic construct
  source 1..18: mol_type = other DNA
aaataattctcgctatcg

SEQ ID NO: 72179 - DNA, 18 bp, synthetic construct
  source 1..18: mol_type = other DNA
aaatacctatcattatag

SEQ ID NO: 72180 - DNA, 18 bp, synthetic construct
  source 1..18: mol_type = other DNA
aaatacgacccagtactg

SEQ ID NO: 72181 - DNA, 18 bp, synthetic construct
  source 1..18: mol_type = other DNA
aaatacgactctttaatg

SEQ ID NO: 72182 - DNA, 18 bp, synthetic construct
  source 1..18: mol_type = other DNA
aaatacgagtcgcaaacg

SEQ ID NO: 72183 - DNA, 18 bp, synthetic construct
  source 1..18: mol_type = other DNA
aaatactactcaatgaag

SEQ ID NO: 72184 - DNA, 18 bp, synthetic construct
  source 1..18: mol_type = other DNA
aaatacttgtcactaatg

SEQ ID NO: 72185 - DNA, 18 bp, synthetic construct
  source 1..18: mol_type = other DNA
aaatatgactcgctgttg

SEQ ID NO: 72186 - DNA, 18 bp, synthetic construct
  source 1..18: mol_type = other DNA
aaatccgtctcactgaag

SEQ ID NO: 72187 - DNA, 18 bp, synthetic construct
  source 1..18: mol_type = other DNA
aaattccactcactgaag

SEQ ID NO: 72188 - DNA, 18 bp, synthetic construct
  source 1..18: mol_type = other DNA
aaattcgaatcactttcg

SEQ ID NO: 72189 - DNA, 18 bp, synthetic construct
  source 1..18: mol_type = other DNA
aaattcgatccactcaag

SEQ ID NO: 72190 - DNA, 18 bp, synthetic construct
  source 1..18: mol_type = other DNA
aaattcgtcaccctattg

SEQ ID NO: 72191 - DNA, 18 bp, synthetic construct
  source 1..18: mol_type = other DNA
aactactactcactaatg

SEQ ID NO: 72192 - DNA, 18 bp, synthetic construct
  source 1..18: mol_type = other DNA
aagtacaacttactgtag

SEQ ID NO: 72193 - DNA, 18 bp, synthetic construct
  source 1..18: mol_type = other DNA
aagttcgactttcaatcg

SEQ ID NO: 72194 - DNA, 18 bp, synthetic construct
  source 1..18: mol_type = other DNA
aatcacgactcaataatg

SEQ ID NO: 72195 - DNA, 18 bp, synthetic construct
  source 1..18: mol_type = other DNA
aatgaataccccctatag

SEQ ID NO: 72196 - DNA, 18 bp, synthetic construct
  source 1..18: mol_type = other DNA
aattacgacacacaaaag

SEQ ID NO: 72197 - DNA, 18 bp, synthetic construct
  source 1..18: mol_type = other DNA
aattacgactctgtattg

SEQ ID NO: 72198 - DNA, 18 bp, synthetic construct
  source 1..18: mol_type = other DNA
aattacgactgatagtag

SEQ ID NO: 72199 - DNA, 18 bp, synthetic construct
  source 1..18: mol_type = other DNA
aatttcaacacactattg

SEQ ID NO: 72200 - DNA, 18 bp, synthetic construct
  source 1..18: mol_type = other DNA
aatttcgattcactacag

SEQ ID NO: 72201 - DNA, 18 bp, synthetic construct
  source 1..18: mol_type = other DNA
agatacgccttactaaag

SEQ ID NO: 72202 - DNA, 18 bp, synthetic construct
  source 1..18: mol_type = other DNA
agatacgtctaactttag

SEQ ID NO: 72203 - DNA, 18 bp, synthetic construct
  source 1..18: mol_type = other DNA
ataaacgacagactttgg

SEQ ID NO: 72204 - DNA, 18 bp, synthetic construct
  source 1..18: mol_type = other DNA
ataaactattcactatag

SEQ ID NO: 72205 - DNA, 18 bp, synthetic construct
  source 1..18: mol_type = other DNA
atacacgactcataatag

SEQ ID NO: 72206 - DNA, 18 bp, synthetic construct
  source 1..18: mol_type = other DNA
atacactactcactgtag

SEQ ID NO: 72207 - DNA, 18 bp, synthetic construct
  source 1..18: mol_type = other DNA
atataactctcactatag

SEQ ID NO: 72208 - DNA, 18 bp, synthetic construct
  source 1..18: mol_type = other DNA
atatacaactcaatattg

SEQ ID NO: 72209 - DNA, 18 bp, synthetic construct
  source 1..18: mol_type = other DNA
atatacaactctcaatag

SEQ ID NO: 72210 - DNA, 18 bp, synthetic construct
  source 1..18: mol_type = other DNA
atataccactcacttttg

SEQ ID NO: 72211 - DNA, 18 bp, synthetic construct
  source 1..18: mol_type = other DNA
atatacgaaacactattg

SEQ ID NO: 72212 - DNA, 18 bp, synthetic construct
  source 1..18: mol_type = other DNA
atatacgactatcgatgg

SEQ ID NO: 72213 - DNA, 18 bp, synthetic construct
  source 1..18: mol_type = other DNA
atatacgctttactatag

SEQ ID NO: 72214 - DNA, 18 bp, synthetic construct
  source 1..18: mol_type = other DNA
atattcgactcactgtcg

SEQ ID NO: 72215 - DNA, 18 bp, synthetic construct
  source 1..18: mol_type = other DNA
atattcgactctctaaag

SEQ ID NO: 72216 - DNA, 18 bp, synthetic construct
  source 1..18: mol_type = other DNA
atattctattcactatag

SEQ ID NO: 72217 - DNA, 18 bp, synthetic construct
  source 1..18: mol_type = other DNA
attaagaactcactaaag

SEQ ID NO: 72218 - DNA, 18 bp, synthetic construct
  source 1..18: mol_type = other DNA
atttaacagtcactatag

SEQ ID NO: 72219 - DNA, 18 bp, synthetic construct
  source 1..18: mol_type = other DNA
caaaacgatacacaatag

SEQ ID NO: 72220 - DNA, 18 bp, synthetic construct
  source 1..18: mol_type = other DNA
caatacatcaaattacag

SEQ ID NO: 72221 - DNA, 18 bp, synthetic construct
  source 1..18: mol_type = other DNA
caatacgactaaggaaag

SEQ ID NO: 72222 - DNA, 18 bp, synthetic construct
  source 1..18: mol_type = other DNA
caatacgtgtcatgattg

SEQ ID NO: 72223 - DNA, 18 bp, synthetic construct
  source 1..18: mol_type = other DNA
caatccgactccctttac

SEQ ID NO: 72224 - DNA, 18 bp, synthetic construct
  source 1..18: mol_type = other DNA
cactacgattcaaaatag

SEQ ID NO: 72225 - DNA, 18 bp, synthetic construct
  source 1..18: mol_type = other DNA
catcactactctctttag

SEQ ID NO: 72226 - DNA, 18 bp, synthetic construct
  source 1..18: mol_type = other DNA
ccacacgaccttctattg

SEQ ID NO: 72227 - DNA, 18 bp, synthetic construct
  source 1..18: mol_type = other DNA
cgattcgactcccagtag

SEQ ID NO: 72228 - DNA, 18 bp, synthetic construct
  source 1..18: mol_type = other DNA
ctatacaactcgctatgg

SEQ ID NO: 72229 - DNA, 18 bp, synthetic construct
  source 1..18: mol_type = other DNA
ctataccactcactaatg

SEQ ID NO: 72230 - DNA, 18 bp, synthetic construct
  source 1..18: mol_type = other DNA
ctatacgatcgattttag

SEQ ID NO: 72231 - DNA, 18 bp, synthetic construct
  source 1..18: mol_type = other DNA
ctctacgattcactatgg

SEQ ID NO: 72232 - DNA, 18 bp, synthetic construct
  source 1..18: mol_type = other DNA
gaaaacgactcttaatag

SEQ ID NO: 72233 - DNA, 18 bp, synthetic construct
  source 1..18: mol_type = other DNA
gaaacttaccaaccatag

SEQ ID NO: 72234 - DNA, 18 bp, synthetic construct
  source 1..18: mol_type = other DNA
gaatccatctcactttag

SEQ ID NO: 72235 - DNA, 18 bp, synthetic construct
  source 1..18: mol_type = other DNA
gagtcagactctttacag

SEQ ID NO: 72236 - DNA, 18 bp, synthetic construct
  source 1..18: mol_type = other DNA
gtatgcgacttactaaag

SEQ ID NO: 72237 - DNA, 18 bp, synthetic construct
  source 1..18: mol_type = other DNA
taaaaagattcattgtag

SEQ ID NO: 72238 - DNA, 18 bp, synthetic construct
  source 1..18: mol_type = other DNA
taaaacaaatcactaatg

SEQ ID NO: 72239 - DNA, 18 bp, synthetic construct
  source 1..18: mol_type = other DNA
taaaacaactataattcg

SEQ ID NO: 72240 - DNA, 18 bp, synthetic construct
  source 1..18: mol_type = other DNA
taaaacgtctcaaattag

SEQ ID NO: 72241 - DNA, 18 bp, synthetic construct
  source 1..18: mol_type = other DNA
taaaacgtctcacatcag

SEQ ID NO: 72242 - DNA, 18 bp, synthetic construct
  source 1..18: mol_type = other DNA
taaaacgtctgattattg

SEQ ID NO: 72243 - DNA, 18 bp, synthetic construct
  source 1..18: mol_type = other DNA
taaaactacacacaacag

SEQ ID NO: 72244 - DNA, 18 bp, synthetic construct
  source 1..18: mol_type = other DNA
taaaatgatacactttag

SEQ ID NO: 72245 - DNA, 18 bp, synthetic construct
  source 1..18: mol_type = other DNA
taaagcctctcattatag

SEQ ID NO: 72246 - DNA, 18 bp, synthetic construct
  source 1..18: mol_type = other DNA
taaagctaatcactattg

SEQ ID NO: 72247 - DNA, 18 bp, synthetic construct
  source 1..18: mol_type = other DNA
taaaggtgttcactatag

SEQ ID NO: 72248 - DNA, 18 bp, synthetic construct
  source 1..18: mol_type = other DNA
taaatcgtcttactattg

SEQ ID NO: 72249 - DNA, 18 bp, synthetic construct
  source 1..18: mol_type = other DNA
taaattgacacactaaag

SEQ ID NO: 72250 - DNA, 18 bp, synthetic construct
  source 1..18: mol_type = other DNA
taaatttactcactaaag

SEQ ID NO: 72251 - DNA, 18 bp, synthetic construct
  source 1..18: mol_type = other DNA
taacacaacccactgaag

SEQ ID NO: 72252 - DNA, 18 bp, synthetic construct
  source 1..18: mol_type = other DNA
taacacctcacagtcaag

SEQ ID NO: 72253 - DNA, 18 bp, synthetic construct
  source 1..18: mol_type = other DNA
taacacgattaacttaag

SEQ ID NO: 72254 - DNA, 18 bp, synthetic construct
  source 1..18: mol_type = other DNA
taacactactcagaaaag

SEQ ID NO: 72255 - DNA, 18 bp, synthetic construct
  source 1..18: mol_type = other DNA
taacatgactttcaatag

SEQ ID NO: 72256 - DNA, 18 bp, synthetic construct
  source 1..18: mol_type = other DNA
taacgcgaaacatcatag

SEQ ID NO: 72257 - DNA, 18 bp, synthetic construct
  source 1..18: mol_type = other DNA
taactcgacacacttaag

SEQ ID NO: 72258 - DNA, 18 bp, synthetic construct
  source 1..18: mol_type = other DNA
taactcgcctccttatag

SEQ ID NO: 72259 - DNA, 18 bp, synthetic construct
  source 1..18: mol_type = other DNA
taagttgacacactctag

SEQ ID NO: 72260 - DNA, 18 bp, synthetic construct
  source 1..18: mol_type = other DNA
taataaaattctcttaag

SEQ ID NO: 72261 - DNA, 18 bp, synthetic construct
  source 1..18: mol_type = other DNA
taataaatctctcgatag

SEQ ID NO: 72262 - DNA, 18 bp, synthetic construct
  source 1..18: mol_type = other DNA
taatacaacacgctaatg

SEQ ID NO: 72263 - DNA, 18 bp, synthetic construct
  source 1..18: mol_type = other DNA
taatacatcaaactgaag

SEQ ID NO: 72264 - DNA, 18 bp, synthetic construct
  source 1..18: mol_type = other DNA
taataccacccatttgag

SEQ ID NO: 72265 - DNA, 18 bp, synthetic construct
  source 1..18: mol_type = other DNA
taataccactcaaagatg

SEQ ID NO: 72266 - DNA, 18 bp, synthetic construct
  source 1..18: mol_type = other DNA
taataccagactctaaag

SEQ ID NO: 72267 - DNA, 18 bp, synthetic construct
  source 1..18: mol_type = other DNA
taatacgacatacatatg

SEQ ID NO: 72268 - DNA, 18 bp, synthetic construct
  source 1..18: mol_type = other DNA
taatacgacctagcaaag

SEQ ID NO: 72269 - DNA, 18 bp, synthetic construct
  source 1..18: mol_type = other DNA
taatacgactttataatg

SEQ ID NO: 72270 - DNA, 18 bp, synthetic construct
  source 1..18: mol_type = other DNA
taatacgcttctctttcg

SEQ ID NO: 72271 - DNA, 18 bp, synthetic construct
  source 1..18: mol_type = other DNA
taatacggcactcaaaag

SEQ ID NO: 72272 - DNA, 18 bp, synthetic construct
  source 1..18: mol_type = other DNA
taatacggcccatataag

SEQ ID NO: 72273 - DNA, 18 bp, synthetic construct
  source 1..18: mol_type = other DNA
taatacggctgccaattg

SEQ ID NO: 72274 - DNA, 18 bp, synthetic construct
  source 1..18: mol_type = other DNA
taatacgtccacatactg

SEQ ID NO: 72275 - DNA, 18 bp, synthetic construct
  source 1..18: mol_type = other DNA
taatacgtctcattcatg

SEQ ID NO: 72276 - DNA, 18 bp, synthetic construct
  source 1..18: mol_type = other DNA
taatacgttccactccag

SEQ ID NO: 72277 - DNA, 18 bp, synthetic construct
  source 1..18: mol_type = other DNA
taatacgtttccataaag

SEQ ID NO: 72278 - DNA, 18 bp, synthetic construct
  source 1..18: mol_type = other DNA
taatactactaaattacg

SEQ ID NO: 72279 - DNA, 18 bp, synthetic construct
  source 1..18: mol_type = other DNA
taatactactcacctatg

SEQ ID NO: 72280 - DNA, 18 bp, synthetic construct
  source 1..18: mol_type = other DNA
taatagcacacacttaag

SEQ ID NO: 72281 - DNA, 18 bp, synthetic construct
  source 1..18: mol_type = other DNA
taataggattttctaaag

SEQ ID NO: 72282 - DNA, 18 bp, synthetic construct
  source 1..18: mol_type = other DNA
taataggtctttctaaag

SEQ ID NO: 72283 - DNA, 18 bp, synthetic construct
  source 1..18: mol_type = other DNA
taatatcaaacactattg

SEQ ID NO: 72284 - DNA, 18 bp, synthetic construct
  source 1..18: mol_type = other DNA
taatatgactattaatag

SEQ ID NO: 72285 - DNA, 18 bp, synthetic construct
  source 1..18: mol_type = other DNA
taatatgatacattattg

SEQ ID NO: 72286 - DNA, 18 bp, synthetic construct
  source 1..18: mol_type = other DNA
taatatgtctccctgaag

SEQ ID NO: 72287 - DNA, 18 bp, synthetic construct
  source 1..18: mol_type = other DNA
taatatgtctctgtattg

SEQ ID NO: 72288 - DNA, 18 bp, synthetic construct
  source 1..18: mol_type = other DNA
taatccatcacactattg

SEQ ID NO: 72289 - DNA, 18 bp, synthetic construct
  source 1..18: mol_type = other DNA
taatccgactttgtagtg

SEQ ID NO: 72290 - DNA, 18 bp, synthetic construct
  source 1..18: mol_type = other DNA
taatccgtctcatttttg

SEQ ID NO: 72291 - DNA, 18 bp, synthetic construct
  source 1..18: mol_type = other DNA
taatcctacactctttag

SEQ ID NO: 72292 - DNA, 18 bp, synthetic construct
  source 1..18: mol_type = other DNA
taatcttactctctctag

SEQ ID NO: 72293 - DNA, 18 bp, synthetic construct
  source 1..18: mol_type = other DNA
taatgacactcactacgg

SEQ ID NO: 72294 - DNA, 18 bp, synthetic construct
  source 1..18: mol_type = other DNA
taatgcaacactctaaag

SEQ ID NO: 72295 - DNA, 18 bp, synthetic construct
  source 1..18: mol_type = other DNA
taattattctcaatatag

SEQ ID NO: 72296 - DNA, 18 bp, synthetic construct
  source 1..18: mol_type = other DNA
taattcgaatctctaatg

SEQ ID NO: 72297 - DNA, 18 bp, synthetic construct
  source 1..18: mol_type = other DNA
taattcgagttaaaattg

SEQ ID NO: 72298 - DNA, 18 bp, synthetic construct
  source 1..18: mol_type = other DNA
taattcggttctctactg

SEQ ID NO: 72299 - DNA, 18 bp, synthetic construct
  source 1..18: mol_type = other DNA
taattcgtctcaacacag

SEQ ID NO: 72300 - DNA, 18 bp, synthetic construct
  source 1..18: mol_type = other DNA
taatttaattcacttaag

SEQ ID NO: 72301 - DNA, 18 bp, synthetic construct
  source 1..18: mol_type = other DNA
taatttgactgatgaaag

SEQ ID NO: 72302 - DNA, 18 bp, synthetic construct
  source 1..18: mol_type = other DNA
taatttgcatcacaatag

SEQ ID NO: 72303 - DNA, 18 bp, synthetic construct
  source 1..18: mol_type = other DNA
taatttggctctctctag

SEQ ID NO: 72304 - DNA, 18 bp, synthetic construct
  source 1..18: mol_type = other DNA
taatttgtcacacaatag

SEQ ID NO: 72305 - DNA, 18 bp, synthetic construct
  source 1..18: mol_type = other DNA
tacaacgtctcaatacag

SEQ ID NO: 72306 - DNA, 18 bp, synthetic construct
  source 1..18: mol_type = other DNA
taccacggctcttaatag

SEQ ID NO: 72307 - DNA, 18 bp, synthetic construct
  source 1..18: mol_type = other DNA
tactacgtctctatttag

SEQ ID NO: 72308 - DNA, 18 bp, synthetic construct
  source 1..18: mol_type = other DNA
tacttcgagacagtttag

SEQ ID NO: 72309 - DNA, 18 bp, synthetic construct
  source 1..18: mol_type = other DNA
tagaacgtctcacattag

SEQ ID NO: 72310 - DNA, 18 bp, synthetic construct
  source 1..18: mol_type = other DNA
tagcacgtctcacattag

SEQ ID NO: 72311 - DNA, 18 bp, synthetic construct
  source 1..18: mol_type = other DNA
tagtaaaactcaacatag

SEQ ID NO: 72312 - DNA, 18 bp, synthetic construct
  source 1..18: mol_type = other DNA
tagtacgagacattattg

SEQ ID NO: 72313 - DNA, 18 bp, synthetic construct
  source 1..18: mol_type = other DNA
tagtacttatccacatag

SEQ ID NO: 72314 - DNA, 18 bp, synthetic construct
  source 1..18: mol_type = other DNA
tagtatgacaaaaaatag

SEQ ID NO: 72315 - DNA, 18 bp, synthetic construct
  source 1..18: mol_type = other DNA
tataacgacgcactcttg

SEQ ID NO: 72316 - DNA, 18 bp, synthetic construct
  source 1..18: mol_type = other DNA
tataacggctgactattg

SEQ ID NO: 72317 - DNA, 18 bp, synthetic construct
  source 1..18: mol_type = other DNA
tataacgtctcacgattg

SEQ ID NO: 72318 - DNA, 18 bp, synthetic construct
  source 1..18: mol_type = other DNA
tataacgttgcactctag

SEQ ID NO: 72319 - DNA, 18 bp, synthetic construct
  source 1..18: mol_type = other DNA
tataatgactctctatcg

SEQ ID NO: 72320 - DNA, 18 bp, synthetic construct
  source 1..18: mol_type = other DNA
tataccgactaacagaag

SEQ ID NO: 72321 - DNA, 18 bp, synthetic construct
  source 1..18: mol_type = other DNA
tatatcgactcacaaagg

SEQ ID NO: 72322 - DNA, 18 bp, synthetic construct
  source 1..18: mol_type = other DNA
tatatcgactctctttag

SEQ ID NO: 72323 - DNA, 18 bp, synthetic construct
  source 1..18: mol_type = other DNA
tatcaccactctctttag

SEQ ID NO: 72324 - DNA, 18 bp, synthetic construct
  source 1..18: mol_type = other DNA
tatcacctctcactttag

SEQ ID NO: 72325 - DNA, 18 bp, synthetic construct
  source 1..18: mol_type = other DNA
tatcacgactctcatttg

SEQ ID NO: 72326 - DNA, 18 bp, synthetic construct
  source 1..18: mol_type = other DNA
tattaagaataaccaatg

SEQ ID NO: 72327 - DNA, 18 bp, synthetic construct
  source 1..18: mol_type = other DNA
tattaatcctcagcatag

SEQ ID NO: 72328 - DNA, 18 bp, synthetic construct
  source 1..18: mol_type = other DNA
tattacctttcactgtag

SEQ ID NO: 72329 - DNA, 18 bp, synthetic construct
  source 1..18: mol_type = other DNA
tattacgaaatacaatag

SEQ ID NO: 72330 - DNA, 18 bp, synthetic construct
  source 1..18: mol_type = other DNA
tattacgaactgctattg

SEQ ID NO: 72331 - DNA, 18 bp, synthetic construct
  source 1..18: mol_type = other DNA
tattacgaataacaatcg

SEQ ID NO: 72332 - DNA, 18 bp, synthetic construct
  source 1..18: mol_type = other DNA
tattacgtcacacttaag

SEQ ID NO: 72333 - DNA, 18 bp, synthetic construct
  source 1..18: mol_type = other DNA
tattacgtctttctattg

SEQ ID NO: 72334 - DNA, 18 bp, synthetic construct
  source 1..18: mol_type = other DNA
tattactacacgatatag

SEQ ID NO: 72335 - DNA, 18 bp, synthetic construct
  source 1..18: mol_type = other DNA
tattactactcacacaag

SEQ ID NO: 72336 - DNA, 18 bp, synthetic construct
  source 1..18: mol_type = other DNA
tattacttctcactaacg

SEQ ID NO: 72337 - DNA, 18 bp, synthetic construct
  source 1..18: mol_type = other DNA
tattagggctcgctcaag

SEQ ID NO: 72338 - DNA, 18 bp, synthetic construct
  source 1..18: mol_type = other DNA
tattaggtctcactgttg

SEQ ID NO: 72339 - DNA, 18 bp, synthetic construct
  source 1..18: mol_type = other DNA
tattatgactcgttgtag

SEQ ID NO: 72340 - DNA, 18 bp, synthetic construct
  source 1..18: mol_type = other DNA
tattatgtctcaacatag

SEQ ID NO: 72341 - DNA, 18 bp, synthetic construct
  source 1..18: mol_type = other DNA
tattatgtcttactgtag

SEQ ID NO: 72342 - DNA, 18 bp, synthetic construct
  source 1..18: mol_type = other DNA
tattattaattactatag

SEQ ID NO: 72343 - DNA, 18 bp, synthetic construct
  source 1..18: mol_type = other DNA
tattattgttctcgatag

SEQ ID NO: 72344 - DNA, 18 bp, synthetic construct
  source 1..18: mol_type = other DNA
tattcctcctcacaaaag

SEQ ID NO: 72345 - DNA, 18 bp, synthetic construct
  source 1..18: mol_type = other DNA
tattctgaatctctaaag

SEQ ID NO: 72346 - DNA, 18 bp, synthetic construct
  source 1..18: mol_type = other DNA
tatttcgacacgctattg

SEQ ID NO: 72347 - DNA, 18 bp, synthetic construct
  source 1..18: mol_type = other DNA
tatttcgacttacaaatg

SEQ ID NO: 72348 - DNA, 18 bp, synthetic construct
  source 1..18: mol_type = other DNA
tatttctaaacactatag

SEQ ID NO: 72349 - DNA, 18 bp, synthetic construct
  source 1..18: mol_type = other DNA
tatttctactttctatag

SEQ ID NO: 72350 - DNA, 18 bp, synthetic construct
  source 1..18: mol_type = other DNA
tcaatagactcacaatag

SEQ ID NO: 72351 - DNA, 18 bp, synthetic construct
  source 1..18: mol_type = other DNA
tcaattgactctcaatag

SEQ ID NO: 72352 - DNA, 18 bp, synthetic construct
  source 1..18: mol_type = other DNA
tcacacgtctcattctag

SEQ ID NO: 72353 - DNA, 18 bp, synthetic construct
  source 1..18: mol_type = other DNA
tcatacaactccgtagtg

SEQ ID NO: 72354 - DNA, 18 bp, synthetic construct
  source 1..18: mol_type = other DNA
tcatacgactcccaaatg

SEQ ID NO: 72355 - DNA, 18 bp, synthetic construct
  source 1..18: mol_type = other DNA
tcatattacacactaaag

SEQ ID NO: 72356 - DNA, 18 bp, synthetic construct
  source 1..18: mol_type = other DNA
tcattcgactcgcaatcg

SEQ ID NO: 72357 - DNA, 18 bp, synthetic construct
  source 1..18: mol_type = other DNA
tcattcgatacactagag

SEQ ID NO: 72358 - DNA, 18 bp, synthetic construct
  source 1..18: mol_type = other DNA
tcctccgattcaataaag

SEQ ID NO: 72359 - DNA, 18 bp, synthetic construct
  source 1..18: mol_type = other DNA
tcgtatgagtgacaatag

SEQ ID NO: 72360 - DNA, 18 bp, synthetic construct
  source 1..18: mol_type = other DNA
tcttacgcttcaatattg

SEQ ID NO: 72361 - DNA, 18 bp, synthetic construct
  source 1..18: mol_type = other DNA
tcttgcgactcgctaaag

SEQ ID NO: 72362 - DNA, 18 bp, synthetic construct
  source 1..18: mol_type = other DNA
tgaaacggctcgctacag

SEQ ID NO: 72363 - DNA, 18 bp, synthetic construct
  source 1..18: mol_type = other DNA
tgaattgacacacaatag

SEQ ID NO: 72364 - DNA, 18 bp, synthetic construct
  source 1..18: mol_type = other DNA
tgactcgactaacgctag

SEQ ID NO: 72365 - DNA, 18 bp, synthetic construct
  source 1..18: mol_type = other DNA
tgatacgtctcgctactg

SEQ ID NO: 72366 - DNA, 18 bp, synthetic construct
  source 1..18: mol_type = other DNA
tgatacgttgcactttag

SEQ ID NO: 72367 - DNA, 18 bp, synthetic construct
  source 1..18: mol_type = other DNA
tgatactccttactaatg

SEQ ID NO: 72368 - DNA, 18 bp, synthetic construct
  source 1..18: mol_type = other DNA
tgatgcgtttctcaatgg

SEQ ID NO: 72369 - DNA, 18 bp, synthetic construct
  source 1..18: mol_type = other DNA
tgattcggcttttttaag

SEQ ID NO: 72370 - DNA, 18 bp, synthetic construct
  source 1..18: mol_type = other DNA
tgattcgtctctatatag

SEQ ID NO: 72371 - DNA, 18 bp, synthetic construct
  source 1..18: mol_type = other DNA
tgctacgatttattaatg

SEQ ID NO: 72372 - DNA, 18 bp, synthetic construct
  source 1..18: mol_type = other DNA
tggcaagactcgcaaaag

SEQ ID NO: 72373 - DNA, 18 bp, synthetic construct
  source 1..18: mol_type = other DNA
tggtacatttcactagag

SEQ ID NO: 72374 - DNA, 18 bp, synthetic construct
  source 1..18: mol_type = other DNA
tgttacgtctctctcaag

SEQ ID NO: 72375 - DNA, 18 bp, synthetic construct
  source 1..18: mol_type = other DNA
tgttacgtctctctctag

SEQ ID NO: 72376 - DNA, 18 bp, synthetic construct
  source 1..18: mol_type = other DNA
ttaaacgacgtcctatag

SEQ ID NO: 72377 - DNA, 18 bp, synthetic construct
  source 1..18: mol_type = other DNA
ttaacggactaactatag

SEQ ID NO: 72378 - DNA, 18 bp, synthetic construct
  source 1..18: mol_type = other DNA
ttaagggactcaccatag

SEQ ID NO: 72379 - DNA, 18 bp, synthetic construct
  source 1..18: mol_type = other DNA
ttacaagactctctaaag

SEQ ID NO: 72380 - DNA, 18 bp, synthetic construct
  source 1..18: mol_type = other DNA
ttaccagactgactctag

SEQ ID NO: 72381 - DNA, 18 bp, synthetic construct
  source 1..18: mol_type = other DNA
ttagtcgattcgctatag

SEQ ID NO: 72382 - DNA, 18 bp, synthetic construct
  source 1..18: mol_type = other DNA
ttataagtcttactattg

SEQ ID NO: 72383 - DNA, 18 bp, synthetic construct
  source 1..18: mol_type = other DNA
ttatacaactatccatag

SEQ ID NO: 72384 - DNA, 18 bp, synthetic construct
  source 1..18: mol_type = other DNA
ttatacatctaacaatag

SEQ ID NO: 72385 - DNA, 18 bp, synthetic construct
  source 1..18: mol_type = other DNA
ttatacgtatcactaatg

SEQ ID NO: 72386 - DNA, 18 bp, synthetic construct
  source 1..18: mol_type = other DNA
ttatacgtcacacttatg

SEQ ID NO: 72387 - DNA, 18 bp, synthetic construct
  source 1..18: mol_type = other DNA
ttatacgtcactctattg

SEQ ID NO: 72388 - DNA, 18 bp, synthetic construct
  source 1..18: mol_type = other DNA
ttatacgttttactaaag

SEQ ID NO: 72389 - DNA, 18 bp, synthetic construct
  source 1..18: mol_type = other DNA
ttatactacttactaatg

SEQ ID NO: 72390 - DNA, 18 bp, synthetic construct
  source 1..18: mol_type = other DNA
ttatccaaatcactaaag

SEQ ID NO: 72391 - DNA, 18 bp, synthetic construct
  source 1..18: mol_type = other DNA
ttatgcatttcactatag

SEQ ID NO: 72392 - DNA, 18 bp, synthetic construct
  source 1..18: mol_type = other DNA
ttatgcgactctacatag

SEQ ID NO: 72393 - DNA, 18 bp, synthetic construct
  source 1..18: mol_type = other DNA
ttatgcgtctcgcaatag

SEQ ID NO: 72394 - DNA, 18 bp, synthetic construct
  source 1..18: mol_type = other DNA
ttattcaactcgcaatag

SEQ ID NO: 72395 - DNA, 18 bp, synthetic construct
  source 1..18: mol_type = other DNA
ttatttgtctcattccag

SEQ ID NO: 72396 - DNA, 18 bp, synthetic construct
  source 1..18: mol_type = other DNA
ttcaacgacactctatag

SEQ ID NO: 72397 - DNA, 18 bp, synthetic construct
  source 1..18: mol_type = other DNA
ttgaacgtctctctatag

SEQ ID NO: 72398 - DNA, 18 bp, synthetic construct
  source 1..18: mol_type = other DNA
tttaatgtctcactatag

SEQ ID NO: 72399 - DNA, 18 bp, synthetic construct
  source 1..18: mol_type = other DNA
tttcacgacacactagag

SEQ ID NO: 72400 - DNA, 18 bp, synthetic construct
  source 1..18: mol_type = other DNA
ttttacgactcatcaacg

SEQ ID NO: 72401 - DNA, 18 bp, synthetic construct
  source 1..18: mol_type = other DNA
ttttacgactttctattg

SEQ ID NO: 72402 - DNA, 18 bp, synthetic construct
  source 1..18: mol_type = other DNA
ttttccaacccactatag

SEQ ID NO: 72403 - DNA, 18 bp, synthetic construct
  source 1..18: mol_type = other DNA
tttttcgacctattttag

SEQ ID NO: 72404 - DNA, 18 bp, synthetic construct
  source 1..18: mol_type = other DNA
tttttcgtctcacaattg

SEQ ID NO: 72405 - DNA, 18 bp, synthetic construct
  source 1..18: mol_type = other DNA
tttttcgtgtaactatag

SEQ ID NO: 72406 - DNA, 18 bp, synthetic construct
  source 1..18: mol_type = other DNA
ttatacgtcacactaatg

SEQ ID NO: 72407 - DNA, 18 bp, synthetic construct
  source 1..18: mol_type = other DNA
taatacgactttcgcatg

SEQ ID NO: 72408 - DNA, 18 bp, synthetic construct
  source 1..18: mol_type = other DNA
aaaaacgtctcagaatag

SEQ ID NO: 72409 - DNA, 18 bp, synthetic construct
  source 1..18: mol_type = other DNA
aaaatcgactcacttatg

SEQ ID NO: 72410 - DNA, 18 bp, synthetic construct
  source 1..18: mol_type = other DNA
aaaatcgtctcactttag

SEQ ID NO: 72411 - DNA, 18 bp, synthetic construct
  source 1..18: mol_type = other DNA
aaacacgtctctctagag

SEQ ID NO: 72412 - DNA, 18 bp, synthetic construct
  source 1..18: mol_type = other DNA
aaacatgactcaataatg

SEQ ID NO: 72413 - DNA, 18 bp, synthetic construct
  source 1..18: mol_type = other DNA
aaataccattctttatag

SEQ ID NO: 72414 - DNA, 18 bp, synthetic construct
  source 1..18: mol_type = other DNA
aaatacgacacacttatg

SEQ ID NO: 72415 - DNA, 18 bp, synthetic construct
  source 1..18: mol_type = other DNA
aaatacgactctcatttg

SEQ ID NO: 72416 - DNA, 18 bp, synthetic construct
  source 1..18: mol_type = other DNA
aaatacgatactctttag

SEQ ID NO: 72417 - DNA, 18 bp, synthetic construct
  source 1..18: mol_type = other DNA
aaatacgcgtcacaaaag

SEQ ID NO: 72418 - DNA, 18 bp, synthetic construct
  source 1..18: mol_type = other DNA
aaatacgtctcattactg

SEQ ID NO: 72419 - DNA, 18 bp, synthetic construct
  source 1..18: mol_type = other DNA
aaatactactcacataag

SEQ ID NO: 72420 - DNA, 18 bp, synthetic construct
  source 1..18: mol_type = other DNA
aaatactcctcacattag

SEQ ID NO: 72421 - DNA, 18 bp, synthetic construct
  source 1..18: mol_type = other DNA
aaatactcctcacttttg

SEQ ID NO: 72422 - DNA, 18 bp, synthetic construct
  source 1..18: mol_type = other DNA
aaatattactcaatttag

SEQ ID NO: 72423 - DNA, 18 bp, synthetic construct
  source 1..18: mol_type = other DNA
aaatccgactctcgtcag

SEQ ID NO: 72424 - DNA, 18 bp, synthetic construct
  source 1..18: mol_type = other DNA
aaatcggactgtctatag

SEQ ID NO: 72425 - DNA, 18 bp, synthetic construct
  source 1..18: mol_type = other DNA
aaattcgactttcaatag

SEQ ID NO: 72426 - DNA, 18 bp, synthetic construct
  source 1..18: mol_type = other DNA
aaatttgaatcacttttg

SEQ ID NO: 72427 - DNA, 18 bp, synthetic construct
  source 1..18: mol_type = other DNA
aacttggactcacataag

SEQ ID NO: 72428 - DNA, 18 bp, synthetic construct
  source 1..18: mol_type = other DNA
aagaatgactcaatatag

SEQ ID NO: 72429 - DNA, 18 bp, synthetic construct
  source 1..18: mol_type = other DNA
aataccgacccactatcg

SEQ ID NO: 72430 - DNA, 18 bp, synthetic construct
  source 1..18: mol_type = other DNA
aatatcgattccctaaag

SEQ ID NO: 72431 - DNA, 18 bp, synthetic construct
  source 1..18: mol_type = other DNA
aattacaactcgcaatag

SEQ ID NO: 72432 - DNA, 18 bp, synthetic construct
  source 1..18: mol_type = other DNA
aattacgatacacaattg

SEQ ID NO: 72433 - DNA, 18 bp, synthetic construct
  source 1..18: mol_type = other DNA
aatttcaactcagtttag

SEQ ID NO: 72434 - DNA, 18 bp, synthetic construct
  source 1..18: mol_type = other DNA
aatttcgtcttactaaag

SEQ ID NO: 72435 - DNA, 18 bp, synthetic construct
  source 1..18: mol_type = other DNA
acatcccattcacttaag

SEQ ID NO: 72436 - DNA, 18 bp, synthetic construct
  source 1..18: mol_type = other DNA
acattcaacacactatag

SEQ ID NO: 72437 - DNA, 18 bp, synthetic construct
  source 1..18: mol_type = other DNA
agagactacacactatag

SEQ ID NO: 72438 - DNA, 18 bp, synthetic construct
  source 1..18: mol_type = other DNA
agatatgccacactttag

SEQ ID NO: 72439 - DNA, 18 bp, synthetic construct
  source 1..18: mol_type = other DNA
atacaccacattctatcg

SEQ ID NO: 72440 - DNA, 18 bp, synthetic construct
  source 1..18: mol_type = other DNA
atataatactcactctag

SEQ ID NO: 72441 - DNA, 18 bp, synthetic construct
  source 1..18: mol_type = other DNA
atatacgacactctgtag

SEQ ID NO: 72442 - DNA, 18 bp, synthetic construct
  source 1..18: mol_type = other DNA
atatacgtctctctctag

SEQ ID NO: 72443 - DNA, 18 bp, synthetic construct
  source 1..18: mol_type = other DNA
atatacgtcttacttttg

SEQ ID NO: 72444 - DNA, 18 bp, synthetic construct
  source 1..18: mol_type = other DNA
atataggactaactattg

SEQ ID NO: 72445 - DNA, 18 bp, synthetic construct
  source 1..18: mol_type = other DNA
atattcaactcactattg

SEQ ID NO: 72446 - DNA, 18 bp, synthetic construct
  source 1..18: mol_type = other DNA
atattcgactccctctag

SEQ ID NO: 72447 - DNA, 18 bp, synthetic construct
  source 1..18: mol_type = other DNA
atgtacttctcactatag

SEQ ID NO: 72448 - DNA, 18 bp, synthetic construct
  source 1..18: mol_type = other DNA
attaaatactcactttag

SEQ ID NO: 72449 - DNA, 18 bp, synthetic construct
  source 1..18: mol_type = other DNA
atttacaactcacaatag

SEQ ID NO: 72450 - DNA, 18 bp, synthetic construct
  source 1..18: mol_type = other DNA
caaatcggctatcaaagg

SEQ ID NO: 72451 - DNA, 18 bp, synthetic construct
  source 1..18: mol_type = other DNA
caatacgactctcttatg

SEQ ID NO: 72452 - DNA, 18 bp, synthetic construct
  source 1..18: mol_type = other DNA
caattcgattaacatcag

SEQ ID NO: 72453 - DNA, 18 bp, synthetic construct
  source 1..18: mol_type = other DNA
cactactacttaatagag

SEQ ID NO: 72454 - DNA, 18 bp, synthetic construct
  source 1..18: mol_type = other DNA
ccaatcgttacactatag

SEQ ID NO: 72455 - DNA, 18 bp, synthetic construct
  source 1..18: mol_type = other DNA
ccataagactcactcaag

SEQ ID NO: 72456 - DNA, 18 bp, synthetic construct
  source 1..18: mol_type = other DNA
ccatacgtatgactgcag

SEQ ID NO: 72457 - DNA, 18 bp, synthetic construct
  source 1..18: mol_type = other DNA
ctaaacgacacactttag

SEQ ID NO: 72458 - DNA, 18 bp, synthetic construct
  source 1..18: mol_type = other DNA
ctaaacgactcactcaag

SEQ ID NO: 72459 - DNA, 18 bp, synthetic construct
  source 1..18: mol_type = other DNA
ctatacgtctctctttag

SEQ ID NO: 72460 - DNA, 18 bp, synthetic construct
  source 1..18: mol_type = other DNA
ctatacgtttctctaaag

SEQ ID NO: 72461 - DNA, 18 bp, synthetic construct
  source 1..18: mol_type = other DNA
gacaaagactcaatagag

SEQ ID NO: 72462 - DNA, 18 bp, synthetic construct
  source 1..18: mol_type = other DNA
gattaggatacactatag

SEQ ID NO: 72463 - DNA, 18 bp, synthetic construct
  source 1..18: mol_type = other DNA
taaaaaaacttacaatag

SEQ ID NO: 72464 - DNA, 18 bp, synthetic construct
  source 1..18: mol_type = other DNA
taaaaagacacaccacag

SEQ ID NO: 72465 - DNA, 18 bp, synthetic construct
  source 1..18: mol_type = other DNA
taaaaagtcttaccatag

SEQ ID NO: 72466 - DNA, 18 bp, synthetic construct
  source 1..18: mol_type = other DNA
taaaacaaatctatatag

SEQ ID NO: 72467 - DNA, 18 bp, synthetic construct
  source 1..18: mol_type = other DNA
taaaaccactttctttag

SEQ ID NO: 72468 - DNA, 18 bp, synthetic construct
  source 1..18: mol_type = other DNA
taaaacgaaacacattag

SEQ ID NO: 72469 - DNA, 18 bp, synthetic construct
  source 1..18: mol_type = other DNA
taaaattgctcactaatg

SEQ ID NO: 72470 - DNA, 18 bp, synthetic construct
  source 1..18: mol_type = other DNA
taaactgactctctttag

SEQ ID NO: 72471 - DNA, 18 bp, synthetic construct
  source 1..18: mol_type = other DNA
taaatgcgctcactgtag

SEQ ID NO: 72472 - DNA, 18 bp, synthetic construct
  source 1..18: mol_type = other DNA
taacaagacttcctaatg

SEQ ID NO: 72473 - DNA, 18 bp, synthetic construct
  source 1..18: mol_type = other DNA
taacacgacaaggtattg

SEQ ID NO: 72474 - DNA, 18 bp, synthetic construct
  source 1..18: mol_type = other DNA
taacacgtttctcaatag

SEQ ID NO: 72475 - DNA, 18 bp, synthetic construct
  source 1..18: mol_type = other DNA
taacatgaaacactattg

SEQ ID NO: 72476 - DNA, 18 bp, synthetic construct
  source 1..18: mol_type = other DNA
taataacaatctctttag

SEQ ID NO: 72477 - DNA, 18 bp, synthetic construct
  source 1..18: mol_type = other DNA
taataagactcatttatg

SEQ ID NO: 72478 - DNA, 18 bp, synthetic construct
  source 1..18: mol_type = other DNA
taataagatttaatctag

SEQ ID NO: 72479 - DNA, 18 bp, synthetic construct
  source 1..18: mol_type = other DNA
taataatatacactattg

SEQ ID NO: 72480 - DNA, 18 bp, synthetic construct
  source 1..18: mol_type = other DNA
taatacaacacaattttg

SEQ ID NO: 72481 - DNA, 18 bp, synthetic construct
  source 1..18: mol_type = other DNA
taatacaagtcacagaag

SEQ ID NO: 72482 - DNA, 18 bp, synthetic construct
  source 1..18: mol_type = other DNA
taatacattacactatcg

SEQ ID NO: 72483 - DNA, 18 bp, synthetic construct
  source 1..18: mol_type = other DNA
taatacgaaatacaattg

SEQ ID NO: 72484 - DNA, 18 bp, synthetic construct
  source 1..18: mol_type = other DNA
taatacgaaatattattg

SEQ ID NO: 72485 - DNA, 18 bp, synthetic construct
  source 1..18: mol_type = other DNA
taatacgacacgtattag

SEQ ID NO: 72486 - DNA, 18 bp, synthetic construct
  source 1..18: mol_type = other DNA
taatacgacttcttaatg

SEQ ID NO: 72487 - DNA, 18 bp, synthetic construct
  source 1..18: mol_type = other DNA
taatacgagactcattag

SEQ ID NO: 72488 - DNA, 18 bp, synthetic construct
  source 1..18: mol_type = other DNA
taatacgtctgtcttttg

SEQ ID NO: 72489 - DNA, 18 bp, synthetic construct
  source 1..18: mol_type = other DNA
taatacttgtcaataaag

SEQ ID NO: 72490 - DNA, 18 bp, synthetic construct
  source 1..18: mol_type = other DNA
taataggggatgctaaag

SEQ ID NO: 72491 - DNA, 18 bp, synthetic construct
  source 1..18: mol_type = other DNA
taatataactccctaatg

SEQ ID NO: 72492 - DNA, 18 bp, synthetic construct
  source 1..18: mol_type = other DNA
taatatgaaacacgttag

SEQ ID NO: 72493 - DNA, 18 bp, synthetic construct
  source 1..18: mol_type = other DNA
taatatgacttaaaattg

SEQ ID NO: 72494 - DNA, 18 bp, synthetic construct
  source 1..18: mol_type = other DNA
taatatgattcaattaag

SEQ ID NO: 72495 - DNA, 18 bp, synthetic construct
  source 1..18: mol_type = other DNA
taatatgtctcatttaag

SEQ ID NO: 72496 - DNA, 18 bp, synthetic construct
  source 1..18: mol_type = other DNA
taatatgtctctcgaaag

SEQ ID NO: 72497 - DNA, 18 bp, synthetic construct
  source 1..18: mol_type = other DNA
taatctgactcacatgag

SEQ ID NO: 72498 - DNA, 18 bp, synthetic construct
  source 1..18: mol_type = other DNA
taatgcgaacctcaatag

SEQ ID NO: 72499 - DNA, 18 bp, synthetic construct
  source 1..18: mol_type = other DNA
taattcaaatcgctaaag

SEQ ID NO: 72500 - DNA, 18 bp, synthetic construct
  source 1..18: mol_type = other DNA
taattcaattcattaaag

SEQ ID NO: 72501 - DNA, 18 bp, synthetic construct
  source 1..18: mol_type = other DNA
taattcgaatctttattg

SEQ ID NO: 72502 - DNA, 18 bp, synthetic construct
  source 1..18: mol_type = other DNA
taattcgatatgctattg

SEQ ID NO: 72503 - DNA, 18 bp, synthetic construct
  source 1..18: mol_type = other DNA
taattcgcaacacaattg

SEQ ID NO: 72504 - DNA, 18 bp, synthetic construct
  source 1..18: mol_type = other DNA
taattcgtctctctccag

SEQ ID NO: 72505 - DNA, 18 bp, synthetic construct
  source 1..18: mol_type = other DNA
taattcgtgtaacaatag

SEQ ID NO: 72506 - DNA, 18 bp, synthetic construct
  source 1..18: mol_type = other DNA
taattctactcatattag

SEQ ID NO: 72507 - DNA, 18 bp, synthetic construct
  source 1..18: mol_type = other DNA
taattctgctcactaatg

SEQ ID NO: 72508 - DNA, 18 bp, synthetic construct
  source 1..18: mol_type = other DNA
taattgatctcactagtg

SEQ ID NO: 72509 - DNA, 18 bp, synthetic construct
  source 1..18: mol_type = other DNA
taatttggcacactaaag

SEQ ID NO: 72510 - DNA, 18 bp, synthetic construct
  source 1..18: mol_type = other DNA
tacatcgacccacactag

SEQ ID NO: 72511 - DNA, 18 bp, synthetic construct
  source 1..18: mol_type = other DNA
tacgacaactctcactag

SEQ ID NO: 72512 - DNA, 18 bp, synthetic construct
  source 1..18: mol_type = other DNA
tactaagagtctcaatag

SEQ ID NO: 72513 - DNA, 18 bp, synthetic construct
  source 1..18: mol_type = other DNA
tactacgaaaccccatag

SEQ ID NO: 72514 - DNA, 18 bp, synthetic construct
  source 1..18: mol_type = other DNA
tactacgtatcactcaag

SEQ ID NO: 72515 - DNA, 18 bp, synthetic construct
  source 1..18: mol_type = other DNA
tactactactagctattg

SEQ ID NO: 72516 - DNA, 18 bp, synthetic construct
  source 1..18: mol_type = other DNA
tacttcttctgactatag

SEQ ID NO: 72517 - DNA, 18 bp, synthetic construct
  source 1..18: mol_type = other DNA
tagagagactcactaaag

SEQ ID NO: 72518 - DNA, 18 bp, synthetic construct
  source 1..18: mol_type = other DNA
tagcacgattaactatcg

SEQ ID NO: 72519 - DNA, 18 bp, synthetic construct
  source 1..18: mol_type = other DNA
tagtacagctcgaaatag

SEQ ID NO: 72520 - DNA, 18 bp, synthetic construct
  source 1..18: mol_type = other DNA
tataaagactctctattg

SEQ ID NO: 72521 - DNA, 18 bp, synthetic construct
  source 1..18: mol_type = other DNA
tataacgacacaatatcg

SEQ ID NO: 72522 - DNA, 18 bp, synthetic construct
  source 1..18: mol_type = other DNA
tatagcgactcaataaag

SEQ ID NO: 72523 - DNA, 18 bp, synthetic construct
  source 1..18: mol_type = other DNA
tatagcgtctcactattg

SEQ ID NO: 72524 - DNA, 18 bp, synthetic construct
  source 1..18: mol_type = other DNA
tatatatactcactatag

SEQ ID NO: 72525 - DNA, 18 bp, synthetic construct
  source 1..18: mol_type = other DNA
tatatcgacacactctag

SEQ ID NO: 72526 - DNA, 18 bp, synthetic construct
  source 1..18: mol_type = other DNA
tatatcgactgtctttag

SEQ ID NO: 72527 - DNA, 18 bp, synthetic construct
  source 1..18: mol_type = other DNA
tatcaccactcacaaaag

SEQ ID NO: 72528 - DNA, 18 bp, synthetic construct
  source 1..18: mol_type = other DNA
tatcacgttacactttag

SEQ ID NO: 72529 - DNA, 18 bp, synthetic construct
  source 1..18: mol_type = other DNA
tatcatgtctcattatag

SEQ ID NO: 72530 - DNA, 18 bp, synthetic construct
  source 1..18: mol_type = other DNA
tatctccataccctatag

SEQ ID NO: 72531 - DNA, 18 bp, synthetic construct
  source 1..18: mol_type = other DNA
tattacaactcgcattag

SEQ ID NO: 72532 - DNA, 18 bp, synthetic construct
  source 1..18: mol_type = other DNA
tattacaactctttttag

SEQ ID NO: 72533 - DNA, 18 bp, synthetic construct
  source 1..18: mol_type = other DNA
tattacacctcaatattg

SEQ ID NO: 72534 - DNA, 18 bp, synthetic construct
  source 1..18: mol_type = other DNA
tattaccacacacagtag

SEQ ID NO: 72535 - DNA, 18 bp, synthetic construct
  source 1..18: mol_type = other DNA
tattaccattgattatag

SEQ ID NO: 72536 - DNA, 18 bp, synthetic construct
  source 1..18: mol_type = other DNA
tattacgaatctccaaag

SEQ ID NO: 72537 - DNA, 18 bp, synthetic construct
  source 1..18: mol_type = other DNA
tattacgacataccaaag

SEQ ID NO: 72538 - DNA, 18 bp, synthetic construct
  source 1..18: mol_type = other DNA
tattacgactagcttaag

SEQ ID NO: 72539 - DNA, 18 bp, synthetic construct
  source 1..18: mol_type = other DNA
tattacgacttacggttg

SEQ ID NO: 72540 - DNA, 18 bp, synthetic construct
  source 1..18: mol_type = other DNA
tattacgtctaaccttag

SEQ ID NO: 72541 - DNA, 18 bp, synthetic construct
  source 1..18: mol_type = other DNA
tattacgtctaactcttg

SEQ ID NO: 72542 - DNA, 18 bp, synthetic construct
  source 1..18: mol_type = other DNA
tattacgtttaactattg

SEQ ID NO: 72543 - DNA, 18 bp, synthetic construct
  source 1..18: mol_type = other DNA
tattactacctacgatag

SEQ ID NO: 72544 - DNA, 18 bp, synthetic construct
  source 1..18: mol_type = other DNA
tattactactgcttatcg

SEQ ID NO: 72545 - DNA, 18 bp, synthetic construct
  source 1..18: mol_type = other DNA
tattactacttactaatg

SEQ ID NO: 72546 - DNA, 18 bp, synthetic construct
  source 1..18: mol_type = other DNA
tattatcacacactaaag

SEQ ID NO: 72547 - DNA, 18 bp, synthetic construct
  source 1..18: mol_type = other DNA
tattatgaatcacaattg

SEQ ID NO: 72548 - DNA, 18 bp, synthetic construct
  source 1..18: mol_type = other DNA
tattatggctcattctag

SEQ ID NO: 72549 - DNA, 18 bp, synthetic construct
  source 1..18: mol_type = other DNA
tattcacactccctttag

SEQ ID NO: 72550 - DNA, 18 bp, synthetic construct
  source 1..18: mol_type = other DNA
tattcagtctcactagag

SEQ ID NO: 72551 - DNA, 18 bp, synthetic construct
  source 1..18: mol_type = other DNA
tattccgacacaacatag

SEQ ID NO: 72552 - DNA, 18 bp, synthetic construct
  source 1..18: mol_type = other DNA
tattccgcctcacttgag

SEQ ID NO: 72553 - DNA, 18 bp, synthetic construct
  source 1..18: mol_type = other DNA
tattgcgacgttctattg

SEQ ID NO: 72554 - DNA, 18 bp, synthetic construct
  source 1..18: mol_type = other DNA
tattgggactcactaatg

SEQ ID NO: 72555 - DNA, 18 bp, synthetic construct
  source 1..18: mol_type = other DNA
tatttagtctcaatatag

SEQ ID NO: 72556 - DNA, 18 bp, synthetic construct
  source 1..18: mol_type = other DNA
tatttcgattcgctagag

SEQ ID NO: 72557 - DNA, 18 bp, synthetic construct
  source 1..18: mol_type = other DNA
tatttcgtctcacttaag

SEQ ID NO: 72558 - DNA, 18 bp, synthetic construct
  source 1..18: mol_type = other DNA
tcataagaatcacaattg

SEQ ID NO: 72559 - DNA, 18 bp, synthetic construct
  source 1..18: mol_type = other DNA
tcatacaactctttagag

SEQ ID NO: 72560 - DNA, 18 bp, synthetic construct
  source 1..18: mol_type = other DNA
tcatacaattctctaaag

SEQ ID NO: 72561 - DNA, 18 bp, synthetic construct
  source 1..18: mol_type = other DNA
tcatacgtctcgatattg

SEQ ID NO: 72562 - DNA, 18 bp, synthetic construct
  source 1..18: mol_type = other DNA
tcatactactaaacaaag

SEQ ID NO: 72563 - DNA, 18 bp, synthetic construct
  source 1..18: mol_type = other DNA
tcatatgacttattaaag

SEQ ID NO: 72564 - DNA, 18 bp, synthetic construct
  source 1..18: mol_type = other DNA
tcatccgattcacattag

SEQ ID NO: 72565 - DNA, 18 bp, synthetic construct
  source 1..18: mol_type = other DNA
tcattccaatcactaaag

SEQ ID NO: 72566 - DNA, 18 bp, synthetic construct
  source 1..18: mol_type = other DNA
tcctacgacactctaaag

SEQ ID NO: 72567 - DNA, 18 bp, synthetic construct
  source 1..18: mol_type = other DNA
tcctacgtctctctacag

SEQ ID NO: 72568 - DNA, 18 bp, synthetic construct
  source 1..18: mol_type = other DNA
tctaacccctcacaatag

SEQ ID NO: 72569 - DNA, 18 bp, synthetic construct
  source 1..18: mol_type = other DNA
tctaatgactcaatacag

SEQ ID NO: 72570 - DNA, 18 bp, synthetic construct
  source 1..18: mol_type = other DNA
tcttacgacgcattaaag

SEQ ID NO: 72571 - DNA, 18 bp, synthetic construct
  source 1..18: mol_type = other DNA
tgaatggactaactatag

SEQ ID NO: 72572 - DNA, 18 bp, synthetic construct
  source 1..18: mol_type = other DNA
tgatacgacatactttcg

SEQ ID NO: 72573 - DNA, 18 bp, synthetic construct
  source 1..18: mol_type = other DNA
tgatacgcccaacaatag

SEQ ID NO: 72574 - DNA, 18 bp, synthetic construct
  source 1..18: mol_type = other DNA
tgatacgtatcgatattg

SEQ ID NO: 72575 - DNA, 18 bp, synthetic construct
  source 1..18: mol_type = other DNA
tgatactactcatttaag

SEQ ID NO: 72576 - DNA, 18 bp, synthetic construct
  source 1..18: mol_type = other DNA
tgatagagcacacaatag

SEQ ID NO: 72577 - DNA, 18 bp, synthetic construct
  source 1..18: mol_type = other DNA
tgataggagtcactaatg

SEQ ID NO: 72578 - DNA, 18 bp, synthetic construct
  source 1..18: mol_type = other DNA
tgattcgaatctatatag

SEQ ID NO: 72579 - DNA, 18 bp, synthetic construct
  source 1..18: mol_type = other DNA
tgatttcaatcaatatag

SEQ ID NO: 72580 - DNA, 18 bp, synthetic construct
  source 1..18: mol_type = other DNA
tgttacgactccttaacg

SEQ ID NO: 72581 - DNA, 18 bp, synthetic construct
  source 1..18: mol_type = other DNA
ttaaacgattcaggatag

SEQ ID NO: 72582 - DNA, 18 bp, synthetic construct
  source 1..18: mol_type = other DNA
ttaaacgcctcaataaag

SEQ ID NO: 72583 - DNA, 18 bp, synthetic construct
  source 1..18: mol_type = other DNA
ttacacaactcgcttttg

SEQ ID NO: 72584 - DNA, 18 bp, synthetic construct
  source 1..18: mol_type = other DNA
ttacacgacgctttattg

SEQ ID NO: 72585 - DNA, 18 bp, synthetic construct
  source 1..18: mol_type = other DNA
ttaggcgtctaactaaag

SEQ ID NO: 72586 - DNA, 18 bp, synthetic construct
  source 1..18: mol_type = other DNA
ttatacaattcagtaaag

SEQ ID NO: 72587 - DNA, 18 bp, synthetic construct
  source 1..18: mol_type = other DNA
ttatacagctctctacag

SEQ ID NO: 72588 - DNA, 18 bp, synthetic construct
  source 1..18: mol_type = other DNA
ttatacagttcactaaag

SEQ ID NO: 72589 - DNA, 18 bp, synthetic construct
  source 1..18: mol_type = other DNA
ttatacatcacactatcg

SEQ ID NO: 72590 - DNA, 18 bp, synthetic construct
  source 1..18: mol_type = other DNA
ttataccagccactgttg

SEQ ID NO: 72591 - DNA, 18 bp, synthetic construct
  source 1..18: mol_type = other DNA
ttatacgaatagctaatg

SEQ ID NO: 72592 - DNA, 18 bp, synthetic construct
  source 1..18: mol_type = other DNA
ttatacgatttaccttag

SEQ ID NO: 72593 - DNA, 18 bp, synthetic construct
  source 1..18: mol_type = other DNA
ttatacggttctttatag

SEQ ID NO: 72594 - DNA, 18 bp, synthetic construct
  source 1..18: mol_type = other DNA
ttatacgtctaattttag

SEQ ID NO: 72595 - DNA, 18 bp, synthetic construct
  source 1..18: mol_type = other DNA
ttatactactcacaaatg

SEQ ID NO: 72596 - DNA, 18 bp, synthetic construct
  source 1..18: mol_type = other DNA
ttatatttctcactattg

SEQ ID NO: 72597 - DNA, 18 bp, synthetic construct
  source 1..18: mol_type = other DNA
ttatgccactggctatag

SEQ ID NO: 72598 - DNA, 18 bp, synthetic construct
  source 1..18: mol_type = other DNA
ttattcgtatcactatcg

SEQ ID NO: 72599 - DNA, 18 bp, synthetic construct
  source 1..18: mol_type = other DNA
ttattcgtctcacttaag

SEQ ID NO: 72600 - DNA, 18 bp, synthetic construct
  source 1..18: mol_type = other DNA
ttgttcgattctctatag

SEQ ID NO: 72601 - DNA, 18 bp, synthetic construct
  source 1..18: mol_type = other DNA
tttaacctttcactatag

SEQ ID NO: 72602 - DNA, 18 bp, synthetic construct
  source 1..18: mol_type = other DNA
tttaacgtctcacaatag

SEQ ID NO: 72603 - DNA, 18 bp, synthetic construct
  source 1..18: mol_type = other DNA
tttaatcactcactatag

SEQ ID NO: 72604 - DNA, 18 bp, synthetic construct
  source 1..18: mol_type = other DNA
ttttacgactaacattag

SEQ ID NO: 72605 - DNA, 18 bp, synthetic construct
  source 1..18: mol_type = other DNA
ttttacgattaactgtag

SEQ ID NO: 72606 - DNA, 18 bp, synthetic construct
  source 1..18: mol_type = other DNA
ttttacgtcactctatag

SEQ ID NO: 72607 - DNA, 18 bp, synthetic construct
  source 1..18: mol_type = other DNA
ttttgcgactcactcttg

SEQ ID NO: 72608 - DNA, 18 bp, synthetic construct
  source 1..18: mol_type = other DNA
tttttcgactcacttttg

SEQ ID NO: 72609 - DNA, 18 bp, synthetic construct
  source 1..18: mol_type = other DNA
tttttcgactcattttag

SEQ ID NO: 72610 - DNA, 18 bp, synthetic construct
  source 1..18: mol_type = other DNA
taattcgacaaacaattg

SEQ ID NO: 72611 - DNA, 18 bp, synthetic construct
  source 1..18: mol_type = other DNA
tcttactacactctatag

SEQ ID NO: 72612 - DNA, 18 bp, synthetic construct
  source 1..18: mol_type = other DNA
aatttctactctctatag

SEQ ID NO: 72613 - DNA, 18 bp, synthetic construct
  source 1..18: mol_type = other DNA
aaaaacgacacgctagag

SEQ ID NO: 72614 - DNA, 18 bp, synthetic construct
  source 1..18: mol_type = other DNA
aaaaacgactctcttaag

SEQ ID NO: 72615 - DNA, 18 bp, synthetic construct
  source 1..18: mol_type = other DNA
aaaaacgattttctatag

SEQ ID NO: 72616 - DNA, 18 bp, synthetic construct
  source 1..18: mol_type = other DNA
aaaaacgtcacacaatag

SEQ ID NO: 72617 - DNA, 18 bp, synthetic construct
  source 1..18: mol_type = other DNA
aaaatcgactatatatag

SEQ ID NO: 72618 - DNA, 18 bp, synthetic construct
  source 1..18: mol_type = other DNA
aaacacgacccaatagag

SEQ ID NO: 72619 - DNA, 18 bp, synthetic construct
  source 1..18: mol_type = other DNA
aaacacgtctctctattg

SEQ ID NO: 72620 - DNA, 18 bp, synthetic construct
  source 1..18: mol_type = other DNA
aaatacatctctctaaag

SEQ ID NO: 72621 - DNA, 18 bp, synthetic construct
  source 1..18: mol_type = other DNA
aaatacgactatcttaag

SEQ ID NO: 72622 - DNA, 18 bp, synthetic construct
  source 1..18: mol_type = other DNA
aaatacgcctctcttttg

SEQ ID NO: 72623 - DNA, 18 bp, synthetic construct
  source 1..18: mol_type = other DNA
aaatactactcgttttag

SEQ ID NO: 72624 - DNA, 18 bp, synthetic construct
  source 1..18: mol_type = other DNA
aaatacttctcacttaag

SEQ ID NO: 72625 - DNA, 18 bp, synthetic construct
  source 1..18: mol_type = other DNA
aaatatgacaatctatag

SEQ ID NO: 72626 - DNA, 18 bp, synthetic construct
  source 1..18: mol_type = other DNA
aaatatgtctcaacctag

SEQ ID NO: 72627 - DNA, 18 bp, synthetic construct
  source 1..18: mol_type = other DNA
aaattcaagattcaatag

SEQ ID NO: 72628 - DNA, 18 bp, synthetic construct
  source 1..18: mol_type = other DNA
aataacgactcacttaag

SEQ ID NO: 72629 - DNA, 18 bp, synthetic construct
  source 1..18: mol_type = other DNA
aataacgactgaatgtag

SEQ ID NO: 72630 - DNA, 18 bp, synthetic construct
  source 1..18: mol_type = other DNA
aatcacgtctcactaaag

SEQ ID NO: 72631 - DNA, 18 bp, synthetic construct
  source 1..18: mol_type = other DNA
aattacctctcacagtag

SEQ ID NO: 72632 - DNA, 18 bp, synthetic construct
  source 1..18: mol_type = other DNA
aattactacacactattg

SEQ ID NO: 72633 - DNA, 18 bp, synthetic construct
  source 1..18: mol_type = other DNA
aattgcgtctaacaatag

SEQ ID NO: 72634 - DNA, 18 bp, synthetic construct
  source 1..18: mol_type = other DNA
acatacggctatctattg

SEQ ID NO: 72635 - DNA, 18 bp, synthetic construct
  source 1..18: mol_type = other DNA
acatagtacccactttag

SEQ ID NO: 72636 - DNA, 18 bp, synthetic construct
  source 1..18: mol_type = other DNA
ataaaccactcactttag

SEQ ID NO: 72637 - DNA, 18 bp, synthetic construct
  source 1..18: mol_type = other DNA
ataaacgaaccactggag

SEQ ID NO: 72638 - DNA, 18 bp, synthetic construct
  source 1..18: mol_type = other DNA
ataaacgactctctttag

SEQ ID NO: 72639 - DNA, 18 bp, synthetic construct
  source 1..18: mol_type = other DNA
ataaaggactcattatag

SEQ ID NO: 72640 - DNA, 18 bp, synthetic construct
  source 1..18: mol_type = other DNA
atacacgcctcacaatag

SEQ ID NO: 72641 - DNA, 18 bp, synthetic construct
  source 1..18: mol_type = other DNA
atatacgacctactgtag

SEQ ID NO: 72642 - DNA, 18 bp, synthetic construct
  source 1..18: mol_type = other DNA
atatacgtctaactattg

SEQ ID NO: 72643 - DNA, 18 bp, synthetic construct
  source 1..18: mol_type = other DNA
atatacgtctcactcttg

SEQ ID NO: 72644 - DNA, 18 bp, synthetic construct
  source 1..18: mol_type = other DNA
atatacttatcactatag

SEQ ID NO: 72645 - DNA, 18 bp, synthetic construct
  source 1..18: mol_type = other DNA
atatagtactctctatag

SEQ ID NO: 72646 - DNA, 18 bp, synthetic construct
  source 1..18: mol_type = other DNA
atatatgactaacttaag

SEQ ID NO: 72647 - DNA, 18 bp, synthetic construct
  source 1..18: mol_type = other DNA
atatatgactccctctag

SEQ ID NO: 72648 - DNA, 18 bp, synthetic construct
  source 1..18: mol_type = other DNA
atattctaaccactatag

SEQ ID NO: 72649 - DNA, 18 bp, synthetic construct
  source 1..18: mol_type = other DNA
atctgcgtcgcactctag

SEQ ID NO: 72650 - DNA, 18 bp, synthetic construct
  source 1..18: mol_type = other DNA
atttacaactctctatag

SEQ ID NO: 72651 - DNA, 18 bp, synthetic construct
  source 1..18: mol_type = other DNA
atttacgaatctctatag

SEQ ID NO: 72652 - DNA, 18 bp, synthetic construct
  source 1..18: mol_type = other DNA
caaatcgactcactcatg

SEQ ID NO: 72653 - DNA, 18 bp, synthetic construct
  source 1..18: mol_type = other DNA
caatacgacatacaaaag

SEQ ID NO: 72654 - DNA, 18 bp, synthetic construct
  source 1..18: mol_type = other DNA
cagaacgacgcactacag

SEQ ID NO: 72655 - DNA, 18 bp, synthetic construct
  source 1..18: mol_type = other DNA
cgacatgactcactttag

SEQ ID NO: 72656 - DNA, 18 bp, synthetic construct
  source 1..18: mol_type = other DNA
ctgaacgactcactttag

SEQ ID NO: 72657 - DNA, 18 bp, synthetic construct
  source 1..18: mol_type = other DNA
gaccacgagtcacgatag

SEQ ID NO: 72658 - DNA, 18 bp, synthetic construct
  source 1..18: mol_type = other DNA
gatcacgtcacactttag

SEQ ID NO: 72659 - DNA, 18 bp, synthetic construct
  source 1..18: mol_type = other DNA
taaaaccaaacactatcg

SEQ ID NO: 72660 - DNA, 18 bp, synthetic construct
  source 1..18: mol_type = other DNA
taaaacgtccccctttag

SEQ ID NO: 72661 - DNA, 18 bp, synthetic construct
  source 1..18: mol_type = other DNA
taaaacgtctcaaagaag

SEQ ID NO: 72662 - DNA, 18 bp, synthetic construct
  source 1..18: mol_type = other DNA
taaaactaaacactaatg

SEQ ID NO: 72663 - DNA, 18 bp, synthetic construct
  source 1..18: mol_type = other DNA
taaaactaatcacaatgg

SEQ ID NO: 72664 - DNA, 18 bp, synthetic construct
  source 1..18: mol_type = other DNA
taaaatgtcactgtatag

SEQ ID NO: 72665 - DNA, 18 bp, synthetic construct
  source 1..18: mol_type = other DNA
taaaccgactcatttttg

SEQ ID NO: 72666 - DNA, 18 bp, synthetic construct
  source 1..18: mol_type = other DNA
taaatcgtctaactattg

SEQ ID NO: 72667 - DNA, 18 bp, synthetic construct
  source 1..18: mol_type = other DNA
taacacaacccacaattg

SEQ ID NO: 72668 - DNA, 18 bp, synthetic construct
  source 1..18: mol_type = other DNA
taacacgtcacataatag

SEQ ID NO: 72669 - DNA, 18 bp, synthetic construct
  source 1..18: mol_type = other DNA
taactcatctcactgtag

SEQ ID NO: 72670 - DNA, 18 bp, synthetic construct
  source 1..18: mol_type = other DNA
taagacgactcaatgacg

SEQ ID NO: 72671 - DNA, 18 bp, synthetic construct
  source 1..18: mol_type = other DNA
taataacattaactgtag

SEQ ID NO: 72672 - DNA, 18 bp, synthetic construct
  source 1..18: mol_type = other DNA
taataagattctcaacag

SEQ ID NO: 72673 - DNA, 18 bp, synthetic construct
  source 1..18: mol_type = other DNA
taatacaactttatttag

SEQ ID NO: 72674 - DNA, 18 bp, synthetic construct
  source 1..18: mol_type = other DNA
taatacatctctttttag

SEQ ID NO: 72675 - DNA, 18 bp, synthetic construct
  source 1..18: mol_type = other DNA
taataccacagaccgtag

SEQ ID NO: 72676 - DNA, 18 bp, synthetic construct
  source 1..18: mol_type = other DNA
taataccacttccattag

SEQ ID NO: 72677 - DNA, 18 bp, synthetic construct
  source 1..18: mol_type = other DNA
taatacgattttcttaag

SEQ ID NO: 72678 - DNA, 18 bp, synthetic construct
  source 1..18: mol_type = other DNA
taatacgtatctcaaaag

SEQ ID NO: 72679 - DNA, 18 bp, synthetic construct
  source 1..18: mol_type = other DNA
taatacgtcacagttttg

SEQ ID NO: 72680 - DNA, 18 bp, synthetic construct
  source 1..18: mol_type = other DNA
taatacgtcattcaatag

SEQ ID NO: 72681 - DNA, 18 bp, synthetic construct
  source 1..18: mol_type = other DNA
taatacgtctatctaatg

SEQ ID NO: 72682 - DNA, 18 bp, synthetic construct
  source 1..18: mol_type = other DNA
taatacgtttcacattcg

SEQ ID NO: 72683 - DNA, 18 bp, synthetic construct
  source 1..18: mol_type = other DNA
taatactacttgcttttg

SEQ ID NO: 72684 - DNA, 18 bp, synthetic construct
  source 1..18: mol_type = other DNA
taataggtctctctcttg

SEQ ID NO: 72685 - DNA, 18 bp, synthetic construct
  source 1..18: mol_type = other DNA
taatatatctctcaatag

SEQ ID NO: 72686 - DNA, 18 bp, synthetic construct
  source 1..18: mol_type = other DNA
taatatgactcagccacg

SEQ ID NO: 72687 - DNA, 18 bp, synthetic construct
  source 1..18: mol_type = other DNA
taatccgaccctcttttg

SEQ ID NO: 72688 - DNA, 18 bp, synthetic construct
  source 1..18: mol_type = other DNA
taatccgctagactttcg

SEQ ID NO: 72689 - DNA, 18 bp, synthetic construct
  source 1..18: mol_type = other DNA
taatccttctgactattg

SEQ ID NO: 72690 - DNA, 18 bp, synthetic construct
  source 1..18: mol_type = other DNA
taatgcgagactatattg

SEQ ID NO: 72691 - DNA, 18 bp, synthetic construct
  source 1..18: mol_type = other DNA
taatgcggcgcaataaag

SEQ ID NO: 72692 - DNA, 18 bp, synthetic construct
  source 1..18: mol_type = other DNA
taattagacacattacag

SEQ ID NO: 72693 - DNA, 18 bp, synthetic construct
  source 1..18: mol_type = other DNA
taattagattccctaaag

SEQ ID NO: 72694 - DNA, 18 bp, synthetic construct
  source 1..18: mol_type = other DNA
taattcgaattacattag

SEQ ID NO: 72695 - DNA, 18 bp, synthetic construct
  source 1..18: mol_type = other DNA
taattcgagtctcaattg

SEQ ID NO: 72696 - DNA, 18 bp, synthetic construct
  source 1..18: mol_type = other DNA
taattcgtatagctatag

SEQ ID NO: 72697 - DNA, 18 bp, synthetic construct
  source 1..18: mol_type = other DNA
taattcgtcacatcatag

SEQ ID NO: 72698 - DNA, 18 bp, synthetic construct
  source 1..18: mol_type = other DNA
taattcttctcactcaag

SEQ ID NO: 72699 - DNA, 18 bp, synthetic construct
  source 1..18: mol_type = other DNA
tacaacgtctaattatag

SEQ ID NO: 72700 - DNA, 18 bp, synthetic construct
  source 1..18: mol_type = other DNA
tactacgatttacttttg

SEQ ID NO: 72701 - DNA, 18 bp, synthetic construct
  source 1..18: mol_type = other DNA
tactacgtctcatttttg

SEQ ID NO: 72702 - DNA, 18 bp, synthetic construct
  source 1..18: mol_type = other DNA
tagcacgactaattgttg

SEQ ID NO: 72703 - DNA, 18 bp, synthetic construct
  source 1..18: mol_type = other DNA
tagcgtgattcactatag

SEQ ID NO: 72704 - DNA, 18 bp, synthetic construct
  source 1..18: mol_type = other DNA
tagtccgactcaagagag

SEQ ID NO: 72705 - DNA, 18 bp, synthetic construct
  source 1..18: mol_type = other DNA
tagttcgaatcattttag

SEQ ID NO: 72706 - DNA, 18 bp, synthetic construct
  source 1..18: mol_type = other DNA
tagttcgactctcttcag

SEQ ID NO: 72707 - DNA, 18 bp, synthetic construct
  source 1..18: mol_type = other DNA
tataaccacacactttag

SEQ ID NO: 72708 - DNA, 18 bp, synthetic construct
  source 1..18: mol_type = other DNA
tataacgacaaactattg

SEQ ID NO: 72709 - DNA, 18 bp, synthetic construct
  source 1..18: mol_type = other DNA
tataacgacactctaaag

SEQ ID NO: 72710 - DNA, 18 bp, synthetic construct
  source 1..18: mol_type = other DNA
tataacgacactctattg

SEQ ID NO: 72711 - DNA, 18 bp, synthetic construct
  source 1..18: mol_type = other DNA
tatagcaacacactatag

SEQ ID NO: 72712 - DNA, 18 bp, synthetic construct
  source 1..18: mol_type = other DNA
tatcacaaaacataatag

SEQ ID NO: 72713 - DNA, 18 bp, synthetic construct
  source 1..18: mol_type = other DNA
tatcataactcaccatgg

SEQ ID NO: 72714 - DNA, 18 bp, synthetic construct
  source 1..18: mol_type = other DNA
tattacgcttcaatattg

SEQ ID NO: 72715 - DNA, 18 bp, synthetic construct
  source 1..18: mol_type = other DNA
tattacgtctctcaattg

SEQ ID NO: 72716 - DNA, 18 bp, synthetic construct
  source 1..18: mol_type = other DNA
tattactacactcaatag

SEQ ID NO: 72717 - DNA, 18 bp, synthetic construct
  source 1..18: mol_type = other DNA
tattataactcactactg

SEQ ID NO: 72718 - DNA, 18 bp, synthetic construct
  source 1..18: mol_type = other DNA
tattgccactctctattg

SEQ ID NO: 72719 - DNA, 18 bp, synthetic construct
  source 1..18: mol_type = other DNA
tattgtgtctcacaatag

SEQ ID NO: 72720 - DNA, 18 bp, synthetic construct
  source 1..18: mol_type = other DNA
tatttagactcacttttg

SEQ ID NO: 72721 - DNA, 18 bp, synthetic construct
  source 1..18: mol_type = other DNA
tatttcgtctaactaatg

SEQ ID NO: 72722 - DNA, 18 bp, synthetic construct
  source 1..18: mol_type = other DNA
tatttttactcacaatag

SEQ ID NO: 72723 - DNA, 18 bp, synthetic construct
  source 1..18: mol_type = other DNA
tcaatcgtcttagtatgg

SEQ ID NO: 72724 - DNA, 18 bp, synthetic construct
  source 1..18: mol_type = other DNA
tcatacgacatacaattg

SEQ ID NO: 72725 - DNA, 18 bp, synthetic construct
  source 1..18: mol_type = other DNA
tcatacgacgctgtttag

SEQ ID NO: 72726 - DNA, 18 bp, synthetic construct
  source 1..18: mol_type = other DNA
tcatacgattatcaatag

SEQ ID NO: 72727 - DNA, 18 bp, synthetic construct
  source 1..18: mol_type = other DNA
tcatataacttcctatag

SEQ ID NO: 72728 - DNA, 18 bp, synthetic construct
  source 1..18: mol_type = other DNA
tcatatgacattttatcg

SEQ ID NO: 72729 - DNA, 18 bp, synthetic construct
  source 1..18: mol_type = other DNA
tcattcttctgaccatag

SEQ ID NO: 72730 - DNA, 18 bp, synthetic construct
  source 1..18: mol_type = other DNA
tcctcctattcacaaaag

SEQ ID NO: 72731 - DNA, 18 bp, synthetic construct
  source 1..18: mol_type = other DNA
tccttcgactcacttttg

SEQ ID NO: 72732 - DNA, 18 bp, synthetic construct
  source 1..18: mol_type = other DNA
tcttactcatcactaatg

SEQ ID NO: 72733 - DNA, 18 bp, synthetic construct
  source 1..18: mol_type = other DNA
tgaaacaattcattatag

SEQ ID NO: 72734 - DNA, 18 bp, synthetic construct
  source 1..18: mol_type = other DNA
tgactcaacttactatag

SEQ ID NO: 72735 - DNA, 18 bp, synthetic construct
  source 1..18: mol_type = other DNA
tgatacaagtctcttaag

SEQ ID NO: 72736 - DNA, 18 bp, synthetic construct
  source 1..18: mol_type = other DNA
tgatacggctctccattg

SEQ ID NO: 72737 - DNA, 18 bp, synthetic construct
  source 1..18: mol_type = other DNA
tgatacgtctcatattag

SEQ ID NO: 72738 - DNA, 18 bp, synthetic construct
  source 1..18: mol_type = other DNA
tgattccattcacaatag

SEQ ID NO: 72739 - DNA, 18 bp, synthetic construct
  source 1..18: mol_type = other DNA
tgccactatccactattg

SEQ ID NO: 72740 - DNA, 18 bp, synthetic construct
  source 1..18: mol_type = other DNA
tgtaaccactcactattg

SEQ ID NO: 72741 - DNA, 18 bp, synthetic construct
  source 1..18: mol_type = other DNA
tgtaacgacacacaatag

SEQ ID NO: 72742 - DNA, 18 bp, synthetic construct
  source 1..18: mol_type = other DNA
tgttacctctctctttag

SEQ ID NO: 72743 - DNA, 18 bp, synthetic construct
  source 1..18: mol_type = other DNA
tgttacgactcaatgcag

SEQ ID NO: 72744 - DNA, 18 bp, synthetic construct
  source 1..18: mol_type = other DNA
ttaaacaactcactcaag

SEQ ID NO: 72745 - DNA, 18 bp, synthetic construct
  source 1..18: mol_type = other DNA
ttaaacaactcacttaag

SEQ ID NO: 72746 - DNA, 18 bp, synthetic construct
  source 1..18: mol_type = other DNA
ttaaacgacacaatttag

SEQ ID NO: 72747 - DNA, 18 bp, synthetic construct
  source 1..18: mol_type = other DNA
ttaaacgcccggcgatag

SEQ ID NO: 72748 - DNA, 18 bp, synthetic construct
  source 1..18: mol_type = other DNA
ttaaacgtcttatcattg

SEQ ID NO: 72749 - DNA, 18 bp, synthetic construct
  source 1..18: mol_type = other DNA
ttaatcgactcacaaatg

SEQ ID NO: 72750 - DNA, 18 bp, synthetic construct
  source 1..18: mol_type = other DNA
ttacgagactccctttgg

SEQ ID NO: 72751 - DNA, 18 bp, synthetic construct
  source 1..18: mol_type = other DNA
ttactcgacccacaatag

SEQ ID NO: 72752 - DNA, 18 bp, synthetic construct
  source 1..18: mol_type = other DNA
ttataacactgccaatag

SEQ ID NO: 72753 - DNA, 18 bp, synthetic construct
  source 1..18: mol_type = other DNA
ttatacccctcacttaag

SEQ ID NO: 72754 - DNA, 18 bp, synthetic construct
  source 1..18: mol_type = other DNA
ttatacctctctctattg

SEQ ID NO: 72755 - DNA, 18 bp, synthetic construct
  source 1..18: mol_type = other DNA
ttatacgaataacaatcg

SEQ ID NO: 72756 - DNA, 18 bp, synthetic construct
  source 1..18: mol_type = other DNA
ttatacgactaatattag

SEQ ID NO: 72757 - DNA, 18 bp, synthetic construct
  source 1..18: mol_type = other DNA
ttatacgactcgggacag

SEQ ID NO: 72758 - DNA, 18 bp, synthetic construct
  source 1..18: mol_type = other DNA
ttatacgagtccttatgg

SEQ ID NO: 72759 - DNA, 18 bp, synthetic construct
  source 1..18: mol_type = other DNA
ttatacgatagattatag

SEQ ID NO: 72760 - DNA, 18 bp, synthetic construct
  source 1..18: mol_type = other DNA
ttatacgtcacagtacag

SEQ ID NO: 72761 - DNA, 18 bp, synthetic construct
  source 1..18: mol_type = other DNA
ttatacgtctatcaatag

SEQ ID NO: 72762 - DNA, 18 bp, synthetic construct
  source 1..18: mol_type = other DNA
ttatacgtctcagttttg

SEQ ID NO: 72763 - DNA, 18 bp, synthetic construct
  source 1..18: mol_type = other DNA
ttatactacacactgtcg

SEQ ID NO: 72764 - DNA, 18 bp, synthetic construct
  source 1..18: mol_type = other DNA
ttataggagtctctctag

SEQ ID NO: 72765 - DNA, 18 bp, synthetic construct
  source 1..18: mol_type = other DNA
ttatattactcacaattg

SEQ ID NO: 72766 - DNA, 18 bp, synthetic construct
  source 1..18: mol_type = other DNA
ttatattgcactcaaaag

SEQ ID NO: 72767 - DNA, 18 bp, synthetic construct
  source 1..18: mol_type = other DNA
ttatccaattcattggag

SEQ ID NO: 72768 - DNA, 18 bp, synthetic construct
  source 1..18: mol_type = other DNA
ttatgagtctcactactg

SEQ ID NO: 72769 - DNA, 18 bp, synthetic construct
  source 1..18: mol_type = other DNA
ttattcgactcaattaag

SEQ ID NO: 72770 - DNA, 18 bp, synthetic construct
  source 1..18: mol_type = other DNA
ttcttagactcacattag

SEQ ID NO: 72771 - DNA, 18 bp, synthetic construct
  source 1..18: mol_type = other DNA
ttgaacgtatcactatag

SEQ ID NO: 72772 - DNA, 18 bp, synthetic construct
  source 1..18: mol_type = other DNA
tttaacgaatctctatag

SEQ ID NO: 72773 - DNA, 18 bp, synthetic construct
  source 1..18: mol_type = other DNA
tttaacgacacacttcag

SEQ ID NO: 72774 - DNA, 18 bp, synthetic construct
  source 1..18: mol_type = other DNA
tttaatgactcactaaag

SEQ ID NO: 72775 - DNA, 18 bp, synthetic construct
  source 1..18: mol_type = other DNA
ttttaagactcacttaag

SEQ ID NO: 72776 - DNA, 18 bp, synthetic construct
  source 1..18: mol_type = other DNA
ttttacgacccaccatgg

SEQ ID NO: 72777 - DNA, 18 bp, synthetic construct
  source 1..18: mol_type = other DNA
ttaaacgtcacactaaag

SEQ ID NO: 72778 - DNA, 18 bp, synthetic construct
  source 1..18: mol_type = other DNA
tttaacgactctctattg

SEQ ID NO: 72779 - DNA, 18 bp, synthetic construct
  source 1..18: mol_type = other DNA
aaacacgacttacttaag

SEQ ID NO: 72780 - DNA, 18 bp, synthetic construct
  source 1..18: mol_type = other DNA
aaataacaatcactttag

SEQ ID NO: 72781 - DNA, 18 bp, synthetic construct
  source 1..18: mol_type = other DNA
aaataatactctgtatag

SEQ ID NO: 72782 - DNA, 18 bp, synthetic construct
  source 1..18: mol_type = other DNA
aaatacttcacgctatag

SEQ ID NO: 72783 - DNA, 18 bp, synthetic construct
  source 1..18: mol_type = other DNA
aaatccgacaaacaatag

SEQ ID NO: 72784 - DNA, 18 bp, synthetic construct
  source 1..18: mol_type = other DNA
aaatgcacatcactatag

SEQ ID NO: 72785 - DNA, 18 bp, synthetic construct
  source 1..18: mol_type = other DNA
aaattcgtctcacttaag

SEQ ID NO: 72786 - DNA, 18 bp, synthetic construct
  source 1..18: mol_type = other DNA
aagtacgagttgcgatag

SEQ ID NO: 72787 - DNA, 18 bp, synthetic construct
  source 1..18: mol_type = other DNA
aagtacttcacactttag

SEQ ID NO: 72788 - DNA, 18 bp, synthetic construct
  source 1..18: mol_type = other DNA
aatatcgactcactaaag

SEQ ID NO: 72789 - DNA, 18 bp, synthetic construct
  source 1..18: mol_type = other DNA
aatcacttctcactatag

SEQ ID NO: 72790 - DNA, 18 bp, synthetic construct
  source 1..18: mol_type = other DNA
aattacggcttactaaag

SEQ ID NO: 72791 - DNA, 18 bp, synthetic construct
  source 1..18: mol_type = other DNA
aatttcaattcactatag

SEQ ID NO: 72792 - DNA, 18 bp, synthetic construct
  source 1..18: mol_type = other DNA
aatttcgtcacactatag

SEQ ID NO: 72793 - DNA, 18 bp, synthetic construct
  source 1..18: mol_type = other DNA
aatttcgtcgcactctag

SEQ ID NO: 72794 - DNA, 18 bp, synthetic construct
  source 1..18: mol_type = other DNA
ataaacgaatcattagag

SEQ ID NO: 72795 - DNA, 18 bp, synthetic construct
  source 1..18: mol_type = other DNA
ataaacgattctctatag

SEQ ID NO: 72796 - DNA, 18 bp, synthetic construct
  source 1..18: mol_type = other DNA
atataagactcacttttg

SEQ ID NO: 72797 - DNA, 18 bp, synthetic construct
  source 1..18: mol_type = other DNA
atatacgagtcccaaaag

SEQ ID NO: 72798 - DNA, 18 bp, synthetic construct
  source 1..18: mol_type = other DNA
atttactactcactattg

SEQ ID NO: 72799 - DNA, 18 bp, synthetic construct
  source 1..18: mol_type = other DNA
caataccacttacattag

SEQ ID NO: 72800 - DNA, 18 bp, synthetic construct
  source 1..18: mol_type = other DNA
caatacgactatctcttg

SEQ ID NO: 72801 - DNA, 18 bp, synthetic construct
  source 1..18: mol_type = other DNA
caatacgagtatcttacg

SEQ ID NO: 72802 - DNA, 18 bp, synthetic construct
  source 1..18: mol_type = other DNA
caatccgatacactgttg

SEQ ID NO: 72803 - DNA, 18 bp, synthetic construct
  source 1..18: mol_type = other DNA
cattacgacgctcaacag

SEQ ID NO: 72804 - DNA, 18 bp, synthetic construct
  source 1..18: mol_type = other DNA
cattacgactctgtattg

SEQ ID NO: 72805 - DNA, 18 bp, synthetic construct
  source 1..18: mol_type = other DNA
cattacgagtcacaaaag

SEQ ID NO: 72806 - DNA, 18 bp, synthetic construct
  source 1..18: mol_type = other DNA
ccatacgactcgctaagg

SEQ ID NO: 72807 - DNA, 18 bp, synthetic construct
  source 1..18: mol_type = other DNA
ccatacggttcccgatag

SEQ ID NO: 72808 - DNA, 18 bp, synthetic construct
  source 1..18: mol_type = other DNA
ctatgcctcccactttag

SEQ ID NO: 72809 - DNA, 18 bp, synthetic construct
  source 1..18: mol_type = other DNA
gtatgctacttactaaag

SEQ ID NO: 72810 - DNA, 18 bp, synthetic construct
  source 1..18: mol_type = other DNA
taaaacgattctacatag

SEQ ID NO: 72811 - DNA, 18 bp, synthetic construct
  source 1..18: mol_type = other DNA
taaaacgtcacacattag

SEQ ID NO: 72812 - DNA, 18 bp, synthetic construct
  source 1..18: mol_type = other DNA
taaaacgtctctcaattg

SEQ ID NO: 72813 - DNA, 18 bp, synthetic construct
  source 1..18: mol_type = other DNA
taaaactaatctcaacag

SEQ ID NO: 72814 - DNA, 18 bp, synthetic construct
  source 1..18: mol_type = other DNA
taaaccgacctccttttg

SEQ ID NO: 72815 - DNA, 18 bp, synthetic construct
  source 1..18: mol_type = other DNA
taaatctactcaataaag

SEQ ID NO: 72816 - DNA, 18 bp, synthetic construct
  source 1..18: mol_type = other DNA
taacacaactgacaacag

SEQ ID NO: 72817 - DNA, 18 bp, synthetic construct
  source 1..18: mol_type = other DNA
taacacgcatgagtagag

SEQ ID NO: 72818 - DNA, 18 bp, synthetic construct
  source 1..18: mol_type = other DNA
taacacgtccgactattg

SEQ ID NO: 72819 - DNA, 18 bp, synthetic construct
  source 1..18: mol_type = other DNA
taacatgactcagtttaa

SEQ ID NO: 72820 - DNA, 18 bp, synthetic construct
  source 1..18: mol_type = other DNA
taactggtctctctatag

SEQ ID NO: 72821 - DNA, 18 bp, synthetic construct
  source 1..18: mol_type = other DNA
taataagacactcattag

SEQ ID NO: 72822 - DNA, 18 bp, synthetic construct
  source 1..18: mol_type = other DNA
taataagtaacgcgattg

SEQ ID NO: 72823 - DNA, 18 bp, synthetic construct
  source 1..18: mol_type = other DNA
taataagtttcaacgatg

SEQ ID NO: 72824 - DNA, 18 bp, synthetic construct
  source 1..18: mol_type = other DNA
taataatccacactttag

SEQ ID NO: 72825 - DNA, 18 bp, synthetic construct
  source 1..18: mol_type = other DNA
taatacaattctcttaag

SEQ ID NO: 72826 - DNA, 18 bp, synthetic construct
  source 1..18: mol_type = other DNA
taatacatctcaataatg

SEQ ID NO: 72827 - DNA, 18 bp, synthetic construct
  source 1..18: mol_type = other DNA
taatacctctcaccaatg

SEQ ID NO: 72828 - DNA, 18 bp, synthetic construct
  source 1..18: mol_type = other DNA
taatacgtctctcgtttg

SEQ ID NO: 72829 - DNA, 18 bp, synthetic construct
  source 1..18: mol_type = other DNA
taatactattggcattag

SEQ ID NO: 72830 - DNA, 18 bp, synthetic construct
  source 1..18: mol_type = other DNA
taatacttctcgttattg

SEQ ID NO: 72831 - DNA, 18 bp, synthetic construct
  source 1..18: mol_type = other DNA
taatacttctctttctag

SEQ ID NO: 72832 - DNA, 18 bp, synthetic construct
  source 1..18: mol_type = other DNA
taatagaacacaccatgg

SEQ ID NO: 72833 - DNA, 18 bp, synthetic construct
  source 1..18: mol_type = other DNA
taatatctcacactgtag

SEQ ID NO: 72834 - DNA, 18 bp, synthetic construct
  source 1..18: mol_type = other DNA
taatatgcctcacatggg

SEQ ID NO: 72835 - DNA, 18 bp, synthetic construct
  source 1..18: mol_type = other DNA
taatccgacagaaaatag

SEQ ID NO: 72836 - DNA, 18 bp, synthetic construct
  source 1..18: mol_type = other DNA
taattcgacccatattag

SEQ ID NO: 72837 - DNA, 18 bp, synthetic construct
  source 1..18: mol_type = other DNA
taattcgtctcaaaacag

SEQ ID NO: 72838 - DNA, 18 bp, synthetic construct
  source 1..18: mol_type = other DNA
taatttcacacactttag

SEQ ID NO: 72839 - DNA, 18 bp, synthetic construct
  source 1..18: mol_type = other DNA
tacaacgtgtcaatatag

SEQ ID NO: 72840 - DNA, 18 bp, synthetic construct
  source 1..18: mol_type = other DNA
tactaagattcacattag

SEQ ID NO: 72841 - DNA, 18 bp, synthetic construct
  source 1..18: mol_type = other DNA
tagtacggcacaacatgg

SEQ ID NO: 72842 - DNA, 18 bp, synthetic construct
  source 1..18: mol_type = other DNA
tataaagactcactcaag

SEQ ID NO: 72843 - DNA, 18 bp, synthetic construct
  source 1..18: mol_type = other DNA
tataacaactaactgtag

SEQ ID NO: 72844 - DNA, 18 bp, synthetic construct
  source 1..18: mol_type = other DNA
tataacatctcgctattg

SEQ ID NO: 72845 - DNA, 18 bp, synthetic construct
  source 1..18: mol_type = other DNA
tataactactctcaattg

SEQ ID NO: 72846 - DNA, 18 bp, synthetic construct
  source 1..18: mol_type = other DNA
tataactactgactaaag

SEQ ID NO: 72847 - DNA, 18 bp, synthetic construct
  source 1..18: mol_type = other DNA
tataaggactgactaaag

SEQ ID NO: 72848 - DNA, 18 bp, synthetic construct
  source 1..18: mol_type = other DNA
tataattactctcaatag

SEQ ID NO: 72849 - DNA, 18 bp, synthetic construct
  source 1..18: mol_type = other DNA
tatatcgaatcactttag

SEQ ID NO: 72850 - DNA, 18 bp, synthetic construct
  source 1..18: mol_type = other DNA
tatcacatatcactatag

SEQ ID NO: 72851 - DNA, 18 bp, synthetic construct
  source 1..18: mol_type = other DNA
tatcacgacacaataaag

SEQ ID NO: 72852 - DNA, 18 bp, synthetic construct
  source 1..18: mol_type = other DNA
tattaaaactaacccttg

SEQ ID NO: 72853 - DNA, 18 bp, synthetic construct
  source 1..18: mol_type = other DNA
tattacaactttctaaag

SEQ ID NO: 72854 - DNA, 18 bp, synthetic construct
  source 1..18: mol_type = other DNA
tattacgaatatctattg

SEQ ID NO: 72855 - DNA, 18 bp, synthetic construct
  source 1..18: mol_type = other DNA
tattacgactatttattg

SEQ ID NO: 72856 - DNA, 18 bp, synthetic construct
  source 1..18: mol_type = other DNA
tattacgactttcttttg

SEQ ID NO: 72857 - DNA, 18 bp, synthetic construct
  source 1..18: mol_type = other DNA
tattactattaactttag

SEQ ID NO: 72858 - DNA, 18 bp, synthetic construct
  source 1..18: mol_type = other DNA
tattacttctcacattag

SEQ ID NO: 72859 - DNA, 18 bp, synthetic construct
  source 1..18: mol_type = other DNA
tattccgattaactaatg

SEQ ID NO: 72860 - DNA, 18 bp, synthetic construct
  source 1..18: mol_type = other DNA
tatttcaactcagtatcg

SEQ ID NO: 72861 - DNA, 18 bp, synthetic construct
  source 1..18: mol_type = other DNA
tatttcgatccacgattg

SEQ ID NO: 72862 - DNA, 18 bp, synthetic construct
  source 1..18: mol_type = other DNA
tatttctacactctatag

SEQ ID NO: 72863 - DNA, 18 bp, synthetic construct
  source 1..18: mol_type = other DNA
tatttcttctcactaaag

SEQ ID NO: 72864 - DNA, 18 bp, synthetic construct
  source 1..18: mol_type = other DNA
tatttgctctcacaatag

SEQ ID NO: 72865 - DNA, 18 bp, synthetic construct
  source 1..18: mol_type = other DNA
tcacacgtctctctttag

SEQ ID NO: 72866 - DNA, 18 bp, synthetic construct
  source 1..18: mol_type = other DNA
tcatacattccactattg

SEQ ID NO: 72867 - DNA, 18 bp, synthetic construct
  source 1..18: mol_type = other DNA
tctctcgactgattctag

SEQ ID NO: 72868 - DNA, 18 bp, synthetic construct
  source 1..18: mol_type = other DNA
tgaaacgaaccactaaag

SEQ ID NO: 72869 - DNA, 18 bp, synthetic construct
  source 1..18: mol_type = other DNA
tgagacgacaccctacag

SEQ ID NO: 72870 - DNA, 18 bp, synthetic construct
  source 1..18: mol_type = other DNA
tgataccacagactattg

SEQ ID NO: 72871 - DNA, 18 bp, synthetic construct
  source 1..18: mol_type = other DNA
tgatacgacactcttcag

SEQ ID NO: 72872 - DNA, 18 bp, synthetic construct
  source 1..18: mol_type = other DNA
tgatctgtgtttgtaaag

SEQ ID NO: 72873 - DNA, 18 bp, synthetic construct
  source 1..18: mol_type = other DNA
tgttacgactcattcaag

SEQ ID NO: 72874 - DNA, 18 bp, synthetic construct
  source 1..18: mol_type = other DNA
tgtttcgactcattattg

SEQ ID NO: 72875 - DNA, 18 bp, synthetic construct
  source 1..18: mol_type = other DNA
ttaaacggctcacttttg

SEQ ID NO: 72876 - DNA, 18 bp, synthetic construct
  source 1..18: mol_type = other DNA
ttaaactacacataatag

SEQ ID NO: 72877 - DNA, 18 bp, synthetic construct
  source 1..18: mol_type = other DNA
ttacaaggctcacaatag

SEQ ID NO: 72878 - DNA, 18 bp, synthetic construct
  source 1..18: mol_type = other DNA
ttatacaaccaactattg

SEQ ID NO: 72879 - DNA, 18 bp, synthetic construct
  source 1..18: mol_type = other DNA
ttatacaactcacattcg

SEQ ID NO: 72880 - DNA, 18 bp, synthetic construct
  source 1..18: mol_type = other DNA
ttatacgacaaacttaag

SEQ ID NO: 72881 - DNA, 18 bp, synthetic construct
  source 1..18: mol_type = other DNA
ttatacgacttattaatg

SEQ ID NO: 72882 - DNA, 18 bp, synthetic construct
  source 1..18: mol_type = other DNA
ttatacgtcacattctag

SEQ ID NO: 72883 - DNA, 18 bp, synthetic construct
  source 1..18: mol_type = other DNA
ttatacgttccataatag

SEQ ID NO: 72884 - DNA, 18 bp, synthetic construct
  source 1..18: mol_type = other DNA
ttatatggctctctctag

SEQ ID NO: 72885 - DNA, 18 bp, synthetic construct
  source 1..18: mol_type = other DNA
ttatccgtctcagtaaag

SEQ ID NO: 72886 - DNA, 18 bp, synthetic construct
  source 1..18: mol_type = other DNA
ttattagtcacacaattg

SEQ ID NO: 72887 - DNA, 18 bp, synthetic construct
  source 1..18: mol_type = other DNA
ttattcgacatactatcg

SEQ ID NO: 72888 - DNA, 18 bp, synthetic construct
  source 1..18: mol_type = other DNA
ttattcgtatctctatag

SEQ ID NO: 72889 - DNA, 18 bp, synthetic construct
  source 1..18: mol_type = other DNA
ttatttgattcactaaag

SEQ ID NO: 72890 - DNA, 18 bp, synthetic construct
  source 1..18: mol_type = other DNA
ttcaccgatccacaatag

SEQ ID NO: 72891 - DNA, 18 bp, synthetic construct
  source 1..18: mol_type = other DNA
ttgcactaatcacaaaag

SEQ ID NO: 72892 - DNA, 18 bp, synthetic construct
  source 1..18: mol_type = other DNA
ttgtacgaataacttaag

SEQ ID NO: 72893 - DNA, 18 bp, synthetic construct
  source 1..18: mol_type = other DNA
ttgtacgtgttactatag

SEQ ID NO: 72894 - DNA, 18 bp, synthetic construct
  source 1..18: mol_type = other DNA
tttaaagactctctttag

SEQ ID NO: 72895 - DNA, 18 bp, synthetic construct
  source 1..18: mol_type = other DNA
tttttggattcattctcg

SEQ ID NO: 72896 - DNA, 18 bp, synthetic construct
  source 1..18: mol_type = other DNA
ttttacgactctctaatg

SEQ ID NO: 72897 - DNA, 18 bp, synthetic construct
  source 1..18: mol_type = other DNA
aaacatcactcacgttag

SEQ ID NO: 72898 - DNA, 18 bp, synthetic construct
  source 1..18: mol_type = other DNA
aaataagacaaacgatag

SEQ ID NO: 72899 - DNA, 18 bp, synthetic construct
  source 1..18: mol_type = other DNA
aaatacgacatacaattg

SEQ ID NO: 72900 - DNA, 18 bp, synthetic construct
  source 1..18: mol_type = other DNA
aaatatgaccgattgatg

SEQ ID NO: 72901 - DNA, 18 bp, synthetic construct
  source 1..18: mol_type = other DNA
aaattcttttcactatag

SEQ ID NO: 72902 - DNA, 18 bp, synthetic construct
  source 1..18: mol_type = other DNA
aacttcaactctctacag

SEQ ID NO: 72903 - DNA, 18 bp, synthetic construct
  source 1..18: mol_type = other DNA
aagcacgacgctctattg

SEQ ID NO: 72904 - DNA, 18 bp, synthetic construct
  source 1..18: mol_type = other DNA
aataacgaaagacttttg

SEQ ID NO: 72905 - DNA, 18 bp, synthetic construct
  source 1..18: mol_type = other DNA
aatcactactcacaatag

SEQ ID NO: 72906 - DNA, 18 bp, synthetic construct
  source 1..18: mol_type = other DNA
aattacgactcaattttg

SEQ ID NO: 72907 - DNA, 18 bp, synthetic construct
  source 1..18: mol_type = other DNA
aattacgtcatactttag

SEQ ID NO: 72908 - DNA, 18 bp, synthetic construct
  source 1..18: mol_type = other DNA
actaacgtctcactatag

SEQ ID NO: 72909 - DNA, 18 bp, synthetic construct
  source 1..18: mol_type = other DNA
agataagaaacactatag

SEQ ID NO: 72910 - DNA, 18 bp, synthetic construct
  source 1..18: mol_type = other DNA
aggtacgacaagctatcg

SEQ ID NO: 72911 - DNA, 18 bp, synthetic construct
  source 1..18: mol_type = other DNA
ataaacaaatcactatag

SEQ ID NO: 72912 - DNA, 18 bp, synthetic construct
  source 1..18: mol_type = other DNA
ataatcaactcactttag

SEQ ID NO: 72913 - DNA, 18 bp, synthetic construct
  source 1..18: mol_type = other DNA
atatacgaaccacaatag

SEQ ID NO: 72914 - DNA, 18 bp, synthetic construct
  source 1..18: mol_type = other DNA
atatacgacagaagatag

SEQ ID NO: 72915 - DNA, 18 bp, synthetic construct
  source 1..18: mol_type = other DNA
atatacgactctcaattg

SEQ ID NO: 72916 - DNA, 18 bp, synthetic construct
  source 1..18: mol_type = other DNA
atataggcatcacaatgg

SEQ ID NO: 72917 - DNA, 18 bp, synthetic construct
  source 1..18: mol_type = other DNA
atttaagactcactattg

SEQ ID NO: 72918 - DNA, 18 bp, synthetic construct
  source 1..18: mol_type = other DNA
caaatcgactttcgtacg

SEQ ID NO: 72919 - DNA, 18 bp, synthetic construct
  source 1..18: mol_type = other DNA
caatacgattttctttag

SEQ ID NO: 72920 - DNA, 18 bp, synthetic construct
  source 1..18: mol_type = other DNA
caattccactcaccattg

SEQ ID NO: 72921 - DNA, 18 bp, synthetic construct
  source 1..18: mol_type = other DNA
ctatatggctcactattg

SEQ ID NO: 72922 - DNA, 18 bp, synthetic construct
  source 1..18: mol_type = other DNA
taaaaagaatctcaatag

SEQ ID NO: 72923 - DNA, 18 bp, synthetic construct
  source 1..18: mol_type = other DNA
taaaacgacacttaatag

SEQ ID NO: 72924 - DNA, 18 bp, synthetic construct
  source 1..18: mol_type = other DNA
taaaacgtcacaccgtag

SEQ ID NO: 72925 - DNA, 18 bp, synthetic construct
  source 1..18: mol_type = other DNA
taaaactcctcacaaaag

SEQ ID NO: 72926 - DNA, 18 bp, synthetic construct
  source 1..18: mol_type = other DNA
taaaagattacgctagag

SEQ ID NO: 72927 - DNA, 18 bp, synthetic construct
  source 1..18: mol_type = other DNA
taaaataactcacttaag

SEQ ID NO: 72928 - DNA, 18 bp, synthetic construct
  source 1..18: mol_type = other DNA
taaaatgatacacaatag

SEQ ID NO: 72929 - DNA, 18 bp, synthetic construct
  source 1..18: mol_type = other DNA
taaatcgacttcttatag

SEQ ID NO: 72930 - DNA, 18 bp, synthetic construct
  source 1..18: mol_type = other DNA
taaatcgatacactttag

SEQ ID NO: 72931 - DNA, 18 bp, synthetic construct
  source 1..18: mol_type = other DNA
taaattgagtcactgaag

SEQ ID NO: 72932 - DNA, 18 bp, synthetic construct
  source 1..18: mol_type = other DNA
taacacgacctactcaag

SEQ ID NO: 72933 - DNA, 18 bp, synthetic construct
  source 1..18: mol_type = other DNA
taactcgactgactaagg

SEQ ID NO: 72934 - DNA, 18 bp, synthetic construct
  source 1..18: mol_type = other DNA
taataagattctcttttg

SEQ ID NO: 72935 - DNA, 18 bp, synthetic construct
  source 1..18: mol_type = other DNA
taatacggttcaccactg

SEQ ID NO: 72936 - DNA, 18 bp, synthetic construct
  source 1..18: mol_type = other DNA
taatacgtataacattag

SEQ ID NO: 72937 - DNA, 18 bp, synthetic construct
  source 1..18: mol_type = other DNA
taatacgtcccatttttg

SEQ ID NO: 72938 - DNA, 18 bp, synthetic construct
  source 1..18: mol_type = other DNA
taatacgtctctcatttg

SEQ ID NO: 72939 - DNA, 18 bp, synthetic construct
  source 1..18: mol_type = other DNA
taatacgtcttacaaatg

SEQ ID NO: 72940 - DNA, 18 bp, synthetic construct
  source 1..18: mol_type = other DNA
taatactatacacattag

SEQ ID NO: 72941 - DNA, 18 bp, synthetic construct
  source 1..18: mol_type = other DNA
taatgccaatcacaaaag

SEQ ID NO: 72942 - DNA, 18 bp, synthetic construct
  source 1..18: mol_type = other DNA
taatgcgtcactctttag

SEQ ID NO: 72943 - DNA, 18 bp, synthetic construct
  source 1..18: mol_type = other DNA
taattcaacttattattg

SEQ ID NO: 72944 - DNA, 18 bp, synthetic construct
  source 1..18: mol_type = other DNA
taattccactctctcttg

SEQ ID NO: 72945 - DNA, 18 bp, synthetic construct
  source 1..18: mol_type = other DNA
taattcctctctcaatag

SEQ ID NO: 72946 - DNA, 18 bp, synthetic construct
  source 1..18: mol_type = other DNA
taattcgaatttctattg

SEQ ID NO: 72947 - DNA, 18 bp, synthetic construct
  source 1..18: mol_type = other DNA
taattcgacttacttatg

SEQ ID NO: 72948 - DNA, 18 bp, synthetic construct
  source 1..18: mol_type = other DNA
taattcgtctaacattag

SEQ ID NO: 72949 - DNA, 18 bp, synthetic construct
  source 1..18: mol_type = other DNA
taattcgtctctctttgg

SEQ ID NO: 72950 - DNA, 18 bp, synthetic construct
  source 1..18: mol_type = other DNA
taattcgtctctcttttg

SEQ ID NO: 72951 - DNA, 18 bp, synthetic construct
  source 1..18: mol_type = other DNA
tactagtactttttatcg

SEQ ID NO: 72952 - DNA, 18 bp, synthetic construct
  source 1..18: mol_type = other DNA
tagaaggcctcacaatag

SEQ ID NO: 72953 - DNA, 18 bp, synthetic construct
  source 1..18: mol_type = other DNA
tagtacaccacaatatag

SEQ ID NO: 72954 - DNA, 18 bp, synthetic construct
  source 1..18: mol_type = other DNA
tataacgacacacattag

SEQ ID NO: 72955 - DNA, 18 bp, synthetic construct
  source 1..18: mol_type = other DNA
tataacgacctactaagg

SEQ ID NO: 72956 - DNA, 18 bp, synthetic construct
  source 1..18: mol_type = other DNA
tataaggtctcactttag

SEQ ID NO: 72957 - DNA, 18 bp, synthetic construct
  source 1..18: mol_type = other DNA
tatatcatctcactatag

SEQ ID NO: 72958 - DNA, 18 bp, synthetic construct
  source 1..18: mol_type = other DNA
tatcatgagtcactgtag

SEQ ID NO: 72959 - DNA, 18 bp, synthetic construct
  source 1..18: mol_type = other DNA
tatctcgacactagttag

SEQ ID NO: 72960 - DNA, 18 bp, synthetic construct
  source 1..18: mol_type = other DNA
tattaaaactcacttaag

SEQ ID NO: 72961 - DNA, 18 bp, synthetic construct
  source 1..18: mol_type = other DNA
tattacatctcaataaag

SEQ ID NO: 72962 - DNA, 18 bp, synthetic construct
  source 1..18: mol_type = other DNA
tattacgtctttctttag

SEQ ID NO: 72963 - DNA, 18 bp, synthetic construct
  source 1..18: mol_type = other DNA
tattacgtttcagtttag

SEQ ID NO: 72964 - DNA, 18 bp, synthetic construct
  source 1..18: mol_type = other DNA
tattatgactcacgtaag

SEQ ID NO: 72965 - DNA, 18 bp, synthetic construct
  source 1..18: mol_type = other DNA
tattatgattctctttag

SEQ ID NO: 72966 - DNA, 18 bp, synthetic construct
  source 1..18: mol_type = other DNA
tattccgactctataaag

SEQ ID NO: 72967 - DNA, 18 bp, synthetic construct
  source 1..18: mol_type = other DNA
tattgttcctgactaaag

SEQ ID NO: 72968 - DNA, 18 bp, synthetic construct
  source 1..18: mol_type = other DNA
tatttcgaatcacttcag

SEQ ID NO: 72969 - DNA, 18 bp, synthetic construct
  source 1..18: mol_type = other DNA
tatttcgactagctttag

SEQ ID NO: 72970 - DNA, 18 bp, synthetic construct
  source 1..18: mol_type = other DNA
tatttcttctcactattg

SEQ ID NO: 72971 - DNA, 18 bp, synthetic construct
  source 1..18: mol_type = other DNA
tcatacgactatctttgg

SEQ ID NO: 72972 - DNA, 18 bp, synthetic construct
  source 1..18: mol_type = other DNA
tcatactcttctctttag

SEQ ID NO: 72973 - DNA, 18 bp, synthetic construct
  source 1..18: mol_type = other DNA
tcatccgattcaataaag

SEQ ID NO: 72974 - DNA, 18 bp, synthetic construct
  source 1..18: mol_type = other DNA
tgataagagtccctatcg

SEQ ID NO: 72975 - DNA, 18 bp, synthetic construct
  source 1..18: mol_type = other DNA
tgataggattccctaaag

SEQ ID NO: 72976 - DNA, 18 bp, synthetic construct
  source 1..18: mol_type = other DNA
tgatattgctcaatatag

SEQ ID NO: 72977 - DNA, 18 bp, synthetic construct
  source 1..18: mol_type = other DNA
tgatctgactcaacatag

SEQ ID NO: 72978 - DNA, 18 bp, synthetic construct
  source 1..18: mol_type = other DNA
tgatgcgtctcacaaaag

SEQ ID NO: 72979 - DNA, 18 bp, synthetic construct
  source 1..18: mol_type = other DNA
tgattctattctctatag

SEQ ID NO: 72980 - DNA, 18 bp, synthetic construct
  source 1..18: mol_type = other DNA
ttaaacgactacctttag

SEQ ID NO: 72981 - DNA, 18 bp, synthetic construct
  source 1..18: mol_type = other DNA
ttaatcgacacactaaag

SEQ ID NO: 72982 - DNA, 18 bp, synthetic construct
  source 1..18: mol_type = other DNA
ttataagaatcttgtttg

SEQ ID NO: 72983 - DNA, 18 bp, synthetic construct
  source 1..18: mol_type = other DNA
ttataagattcactaatg

SEQ ID NO: 72984 - DNA, 18 bp, synthetic construct
  source 1..18: mol_type = other DNA
ttatacaaatctctatcg

SEQ ID NO: 72985 - DNA, 18 bp, synthetic construct
  source 1..18: mol_type = other DNA
ttatacaactcctgatag

SEQ ID NO: 72986 - DNA, 18 bp, synthetic construct
  source 1..18: mol_type = other DNA
ttatacgactcatttatg

SEQ ID NO: 72987 - DNA, 18 bp, synthetic construct
  source 1..18: mol_type = other DNA
ttatacgtcacataatag

SEQ ID NO: 72988 - DNA, 18 bp, synthetic construct
  source 1..18: mol_type = other DNA
ttatactattcacaatcg

SEQ ID NO: 72989 - DNA, 18 bp, synthetic construct
  source 1..18: mol_type = other DNA
ttatactattcagtaaag

SEQ ID NO: 72990 - DNA, 18 bp, synthetic construct
  source 1..18: mol_type = other DNA
ttatagtacacacaatag

SEQ ID NO: 72991 - DNA, 18 bp, synthetic construct
  source 1..18: mol_type = other DNA
ttatatcattcacaatag

SEQ ID NO: 72992 - DNA, 18 bp, synthetic construct
  source 1..18: mol_type = other DNA
ttatatgtcttactattg

SEQ ID NO: 72993 - DNA, 18 bp, synthetic construct
  source 1..18: mol_type = other DNA
ttatctagctcactaaag

SEQ ID NO: 72994 - DNA, 18 bp, synthetic construct
  source 1..18: mol_type = other DNA
ttatgcgacaccctttag

SEQ ID NO: 72995 - DNA, 18 bp, synthetic construct
  source 1..18: mol_type = other DNA
ttattcaactcacaattg

SEQ ID NO: 72996 - DNA, 18 bp, synthetic construct
  source 1..18: mol_type = other DNA
ttattccactctctgtag

SEQ ID NO: 72997 - DNA, 18 bp, synthetic construct
  source 1..18: mol_type = other DNA
ttattctacttacagtag

SEQ ID NO: 72998 - DNA, 18 bp, synthetic construct
  source 1..18: mol_type = other DNA
ttcaatgtctcactattg

SEQ ID NO: 72999 - DNA, 18 bp, synthetic construct
  source 1..18: mol_type = other DNA
ttgaacgactctctttag

SEQ ID NO: 73000 - DNA, 18 bp, synthetic construct
  source 1..18: mol_type = other DNA
ttttacgaatcacttaag

SEQ ID NO: 73001 - DNA, 18 bp, synthetic construct
  source 1..18: mol_type = other DNA
ttttacgacacactgaag

SEQ ID NO: 73002 - DNA, 18 bp, synthetic construct
  source 1..18: mol_type = other DNA
tataactactctctattg

SEQ ID NO: 73003 - DNA, 18 bp, synthetic construct
  source 1..18: mol_type = other DNA
aaaaacgacacactcttg

SEQ ID NO: 73004 - DNA, 18 bp, synthetic construct
  source 1..18: mol_type = other DNA
aaaaatgactctcaatag

SEQ ID NO: 73005 - DNA, 18 bp, synthetic construct
  source 1..18: mol_type = other DNA
aaacacgaatcactttgg

SEQ ID NO: 73006 - DNA, 18 bp, synthetic construct
  source 1..18: mol_type = other DNA
aaatacagctccctctag

SEQ ID NO: 73007 - DNA, 18 bp, synthetic construct
  source 1..18: mol_type = other DNA
aaatacgaattacttttg

SEQ ID NO: 73008 - DNA, 18 bp, synthetic construct
  source 1..18: mol_type = other DNA
aaatacgacatactcgag

SEQ ID NO: 73009 - DNA, 18 bp, synthetic construct
  source 1..18: mol_type = other DNA
aaatacgtctctcattag

SEQ ID NO: 73010 - DNA, 18 bp, synthetic construct
  source 1..18: mol_type = other DNA
acatacaactcacttttg

SEQ ID NO: 73011 - DNA, 18 bp, synthetic construct
  source 1..18: mol_type = other DNA
acatacgactctctaatg

SEQ ID NO: 73012 - DNA, 18 bp, synthetic construct
  source 1..18: mol_type = other DNA
acgtacgactgactgcag

SEQ ID NO: 73013 - DNA, 18 bp, synthetic construct
  source 1..18: mol_type = other DNA
ataaacgactcacttttg

SEQ ID NO: 73014 - DNA, 18 bp, synthetic construct
  source 1..18: mol_type = other DNA
atatacgactaactcaag

SEQ ID NO: 73015 - DNA, 18 bp, synthetic construct
  source 1..18: mol_type = other DNA
atatacgactcaaaattg

SEQ ID NO: 73016 - DNA, 18 bp, synthetic construct
  source 1..18: mol_type = other DNA
atatacgactttctattg

SEQ ID NO: 73017 - DNA, 18 bp, synthetic construct
  source 1..18: mol_type = other DNA
atattcgaatcactattg

SEQ ID NO: 73018 - DNA, 18 bp, synthetic construct
  source 1..18: mol_type = other DNA
atcatggaccgactattg

SEQ ID NO: 73019 - DNA, 18 bp, synthetic construct
  source 1..18: mol_type = other DNA
attaactccttactatag

SEQ ID NO: 73020 - DNA, 18 bp, synthetic construct
  source 1..18: mol_type = other DNA
attcacgactcacaatag

SEQ ID NO: 73021 - DNA, 18 bp, synthetic construct
  source 1..18: mol_type = other DNA
atttacaacccactatag

SEQ ID NO: 73022 - DNA, 18 bp, synthetic construct
  source 1..18: mol_type = other DNA
atttacgacgctctaaag

SEQ ID NO: 73023 - DNA, 18 bp, synthetic construct
  source 1..18: mol_type = other DNA
caataccagtcataatag

SEQ ID NO: 73024 - DNA, 18 bp, synthetic construct
  source 1..18: mol_type = other DNA
cgatacgacgtaatatcg

SEQ ID NO: 73025 - DNA, 18 bp, synthetic construct
  source 1..18: mol_type = other DNA
gatatagaaacactacag

SEQ ID NO: 73026 - DNA, 18 bp, synthetic construct
  source 1..18: mol_type = other DNA
taaaacgattctcttcag

SEQ ID NO: 73027 - DNA, 18 bp, synthetic construct
  source 1..18: mol_type = other DNA
taaatcgattcacttttg

SEQ ID NO: 73028 - DNA, 18 bp, synthetic construct
  source 1..18: mol_type = other DNA
taaatctaatcactttag

SEQ ID NO: 73029 - DNA, 18 bp, synthetic construct
  source 1..18: mol_type = other DNA
taactcgtcacactattg

SEQ ID NO: 73030 - DNA, 18 bp, synthetic construct
  source 1..18: mol_type = other DNA
taactcgtctcccaatag

SEQ ID NO: 73031 - DNA, 18 bp, synthetic construct
  source 1..18: mol_type = other DNA
taatacatctcatcgtag

SEQ ID NO: 73032 - DNA, 18 bp, synthetic construct
  source 1..18: mol_type = other DNA
taataccttgctctattg

SEQ ID NO: 73033 - DNA, 18 bp, synthetic construct
  source 1..18: mol_type = other DNA
taatacgaacctcaattg

SEQ ID NO: 73034 - DNA, 18 bp, synthetic construct
  source 1..18: mol_type = other DNA
taatacgccttaaaattg

SEQ ID NO: 73035 - DNA, 18 bp, synthetic construct
  source 1..18: mol_type = other DNA
taatacgtcatacattag

SEQ ID NO: 73036 - DNA, 18 bp, synthetic construct
  source 1..18: mol_type = other DNA
taatacgtcatccagcag

SEQ ID NO: 73037 - DNA, 18 bp, synthetic construct
  source 1..18: mol_type = other DNA
taatacgtctttgtaagg

SEQ ID NO: 73038 - DNA, 18 bp, synthetic construct
  source 1..18: mol_type = other DNA
taatactaattacgttcg

SEQ ID NO: 73039 - DNA, 18 bp, synthetic construct
  source 1..18: mol_type = other DNA
taatatgtctgatcatag

SEQ ID NO: 73040 - DNA, 18 bp, synthetic construct
  source 1..18: mol_type = other DNA
taatcaaactctctatgg

SEQ ID NO: 73041 - DNA, 18 bp, synthetic construct
  source 1..18: mol_type = other DNA
taatcaacattacaatag

SEQ ID NO: 73042 - DNA, 18 bp, synthetic construct
  source 1..18: mol_type = other DNA
taattagaatcactaatg

SEQ ID NO: 73043 - DNA, 18 bp, synthetic construct
  source 1..18: mol_type = other DNA
taatttggcacactattg

SEQ ID NO: 73044 - DNA, 18 bp, synthetic construct
  source 1..18: mol_type = other DNA
tacgttgcctcactatag

SEQ ID NO: 73045 - DNA, 18 bp, synthetic construct
  source 1..18: mol_type = other DNA
tactacgatattcaatag

SEQ ID NO: 73046 - DNA, 18 bp, synthetic construct
  source 1..18: mol_type = other DNA
tacttggacttactattg

SEQ ID NO: 73047 - DNA, 18 bp, synthetic construct
  source 1..18: mol_type = other DNA
tagcacctctcactattg

SEQ ID NO: 73048 - DNA, 18 bp, synthetic construct
  source 1..18: mol_type = other DNA
taggacgtctcaataatg

SEQ ID NO: 73049 - DNA, 18 bp, synthetic construct
  source 1..18: mol_type = other DNA
tagtatcactcgttatag

SEQ ID NO: 73050 - DNA, 18 bp, synthetic construct
  source 1..18: mol_type = other DNA
tagttccacacactaaag

SEQ ID NO: 73051 - DNA, 18 bp, synthetic construct
  source 1..18: mol_type = other DNA
tagttctacacacgatag

SEQ ID NO: 73052 - DNA, 18 bp, synthetic construct
  source 1..18: mol_type = other DNA
tagttctactcacttatg

SEQ ID NO: 73053 - DNA, 18 bp, synthetic construct
  source 1..18: mol_type = other DNA
tataacgacacacaaaag

SEQ ID NO: 73054 - DNA, 18 bp, synthetic construct
  source 1..18: mol_type = other DNA
tataacgactctgtttag

SEQ ID NO: 73055 - DNA, 18 bp, synthetic construct
  source 1..18: mol_type = other DNA
tataaggtctcaatatcg

SEQ ID NO: 73056 - DNA, 18 bp, synthetic construct
  source 1..18: mol_type = other DNA
tatagcgattgacttttg

SEQ ID NO: 73057 - DNA, 18 bp, synthetic construct
  source 1..18: mol_type = other DNA
tatatcgactcactaacg

SEQ ID NO: 73058 - DNA, 18 bp, synthetic construct
  source 1..18: mol_type = other DNA
tatcacgcatctttttag

SEQ ID NO: 73059 - DNA, 18 bp, synthetic construct
  source 1..18: mol_type = other DNA
tatcacgtctaacgatag

SEQ ID NO: 73060 - DNA, 18 bp, synthetic construct
  source 1..18: mol_type = other DNA
tatcgctactccctatag

SEQ ID NO: 73061 - DNA, 18 bp, synthetic construct
  source 1..18: mol_type = other DNA
tatggcgactcattaaag

SEQ ID NO: 73062 - DNA, 18 bp, synthetic construct
  source 1..18: mol_type = other DNA
tattaagacattctatag

SEQ ID NO: 73063 - DNA, 18 bp, synthetic construct
  source 1..18: mol_type = other DNA
tattacgacttacttatg

SEQ ID NO: 73064 - DNA, 18 bp, synthetic construct
  source 1..18: mol_type = other DNA
tattacgatactctttag

SEQ ID NO: 73065 - DNA, 18 bp, synthetic construct
  source 1..18: mol_type = other DNA
tattacgcttctctttag

SEQ ID NO: 73066 - DNA, 18 bp, synthetic construct
  source 1..18: mol_type = other DNA
tattactaatcacaaaag

SEQ ID NO: 73067 - DNA, 18 bp, synthetic construct
  source 1..18: mol_type = other DNA
tattactacacacaattg

SEQ ID NO: 73068 - DNA, 18 bp, synthetic construct
  source 1..18: mol_type = other DNA
tattaggaagcgatatcg

SEQ ID NO: 73069 - DNA, 18 bp, synthetic construct
  source 1..18: mol_type = other DNA
tattatgacttacattag

SEQ ID NO: 73070 - DNA, 18 bp, synthetic construct
  source 1..18: mol_type = other DNA
tatttaaactcactttag

SEQ ID NO: 73071 - DNA, 18 bp, synthetic construct
  source 1..18: mol_type = other DNA
tatttcgactcatttttg

SEQ ID NO: 73072 - DNA, 18 bp, synthetic construct
  source 1..18: mol_type = other DNA
tatttcgtcactctatag

SEQ ID NO: 73073 - DNA, 18 bp, synthetic construct
  source 1..18: mol_type = other DNA
tcatacgattaactcatg

SEQ ID NO: 73074 - DNA, 18 bp, synthetic construct
  source 1..18: mol_type = other DNA
tcattcgtcttactttag

SEQ ID NO: 73075 - DNA, 18 bp, synthetic construct
  source 1..18: mol_type = other DNA
tgaccccactgcgtatag

SEQ ID NO: 73076 - DNA, 18 bp, synthetic construct
  source 1..18: mol_type = other DNA
tgatccgattcaccattg

SEQ ID NO: 73077 - DNA, 18 bp, synthetic construct
  source 1..18: mol_type = other DNA
tgatgttgctcactattg

SEQ ID NO: 73078 - DNA, 18 bp, synthetic construct
  source 1..18: mol_type = other DNA
ttaaacaactcaataaag

SEQ ID NO: 73079 - DNA, 18 bp, synthetic construct
  source 1..18: mol_type = other DNA
ttaaataactctctatag

SEQ ID NO: 73080 - DNA, 18 bp, synthetic construct
  source 1..18: mol_type = other DNA
ttaagcgtttcactatag

SEQ ID NO: 73081 - DNA, 18 bp, synthetic construct
  source 1..18: mol_type = other DNA
ttacacgactctataaag

SEQ ID NO: 73082 - DNA, 18 bp, synthetic construct
  source 1..18: mol_type = other DNA
ttatacgaatcacttatg

SEQ ID NO: 73083 - DNA, 18 bp, synthetic construct
  source 1..18: mol_type = other DNA
ttatacgtcactccatag

SEQ ID NO: 73084 - DNA, 18 bp, synthetic construct
  source 1..18: mol_type = other DNA
ttatacgttgcccaatag

SEQ ID NO: 73085 - DNA, 18 bp, synthetic construct
  source 1..18: mol_type = other DNA
ttatactaatttcttttg

SEQ ID NO: 73086 - DNA, 18 bp, synthetic construct
  source 1..18: mol_type = other DNA
ttatactacacactcaag

SEQ ID NO: 73087 - DNA, 18 bp, synthetic construct
  source 1..18: mol_type = other DNA
ttataggactaaataaag

SEQ ID NO: 73088 - DNA, 18 bp, synthetic construct
  source 1..18: mol_type = other DNA
ttatatgacacacttttg

SEQ ID NO: 73089 - DNA, 18 bp, synthetic construct
  source 1..18: mol_type = other DNA
ttatattactcactaatg

SEQ ID NO: 73090 - DNA, 18 bp, synthetic construct
  source 1..18: mol_type = other DNA
ttattcaactatctatag

SEQ ID NO: 73091 - DNA, 18 bp, synthetic construct
  source 1..18: mol_type = other DNA
ttattcaactccttatag

SEQ ID NO: 73092 - DNA, 18 bp, synthetic construct
  source 1..18: mol_type = other DNA
ttattcaactctttatag

SEQ ID NO: 73093 - DNA, 18 bp, synthetic construct
  source 1..18: mol_type = other DNA
ttattccacacactctag

SEQ ID NO: 73094 - DNA, 18 bp, synthetic construct
  source 1..18: mol_type = other DNA
ttattcgattcattaaag

SEQ ID NO: 73095 - DNA, 18 bp, synthetic construct
  source 1..18: mol_type = other DNA
ttgtactgctctctatag

SEQ ID NO: 73096 - DNA, 18 bp, synthetic construct
  source 1..18: mol_type = other DNA
ttttaaaactcaatatag

SEQ ID NO: 73097 - DNA, 18 bp, synthetic construct
  source 1..18: mol_type = other DNA
ttttacaactcacattag

SEQ ID NO: 73098 - DNA, 18 bp, synthetic construct
  source 1..18: mol_type = other DNA
ttttgctactcattattg

SEQ ID NO: 73099 - DNA, 18 bp, synthetic construct
  source 1..18: mol_type = other DNA
tatatagactcacaatag

SEQ ID NO: 73100 - DNA, 18 bp, synthetic construct
  source 1..18: mol_type = other DNA
aaactcgactcacttaag

SEQ ID NO: 73101 - DNA, 18 bp, synthetic construct
  source 1..18: mol_type = other DNA
aaatacaattcacttaag

SEQ ID NO: 73102 - DNA, 18 bp, synthetic construct
  source 1..18: mol_type = other DNA
aaatacaattctctaaag

SEQ ID NO: 73103 - DNA, 18 bp, synthetic construct
  source 1..18: mol_type = other DNA
aaatacgaatctccaatg

SEQ ID NO: 73104 - DNA, 18 bp, synthetic construct
  source 1..18: mol_type = other DNA
aaatccaactcattaaag

SEQ ID NO: 73105 - DNA, 18 bp, synthetic construct
  source 1..18: mol_type = other DNA
aaattcgactcacttatg

SEQ ID NO: 73106 - DNA, 18 bp, synthetic construct
  source 1..18: mol_type = other DNA
aattacgtctcactaatg

SEQ ID NO: 73107 - DNA, 18 bp, synthetic construct
  source 1..18: mol_type = other DNA
agatacgacccattttag

SEQ ID NO: 73108 - DNA, 18 bp, synthetic construct
  source 1..18: mol_type = other DNA
ataaacgaatcacttaag

SEQ ID NO: 73109 - DNA, 18 bp, synthetic construct
  source 1..18: mol_type = other DNA
atatacaaatcactattg

SEQ ID NO: 73110 - DNA, 18 bp, synthetic construct
  source 1..18: mol_type = other DNA
atatacaatccactatag

SEQ ID NO: 73111 - DNA, 18 bp, synthetic construct
  source 1..18: mol_type = other DNA
atatacgactaacattag

SEQ ID NO: 73112 - DNA, 18 bp, synthetic construct
  source 1..18: mol_type = other DNA
atataggacacactaaag

SEQ ID NO: 73113 - DNA, 18 bp, synthetic construct
  source 1..18: mol_type = other DNA
atatatgacttacaatag

SEQ ID NO: 73114 - DNA, 18 bp, synthetic construct
  source 1..18: mol_type = other DNA
atattcggctcactcaag

SEQ ID NO: 73115 - DNA, 18 bp, synthetic construct
  source 1..18: mol_type = other DNA
attttctactcactattg

SEQ ID NO: 73116 - DNA, 18 bp, synthetic construct
  source 1..18: mol_type = other DNA
caaaacgtcacacaaaag

SEQ ID NO: 73117 - DNA, 18 bp, synthetic construct
  source 1..18: mol_type = other DNA
caacacgactcagtaagg

SEQ ID NO: 73118 - DNA, 18 bp, synthetic construct
  source 1..18: mol_type = other DNA
cactacgatttacaatag

SEQ ID NO: 73119 - DNA, 18 bp, synthetic construct
  source 1..18: mol_type = other DNA
ctttaggaatcactaaag

SEQ ID NO: 73120 - DNA, 18 bp, synthetic construct
  source 1..18: mol_type = other DNA
taaaaagtctatctatag

SEQ ID NO: 73121 - DNA, 18 bp, synthetic construct
  source 1..18: mol_type = other DNA
taaaacaactcatttttg

SEQ ID NO: 73122 - DNA, 18 bp, synthetic construct
  source 1..18: mol_type = other DNA
taactagactcaatctag

SEQ ID NO: 73123 - DNA, 18 bp, synthetic construct
  source 1..18: mol_type = other DNA
taatacaacactcaaaag

SEQ ID NO: 73124 - DNA, 18 bp, synthetic construct
  source 1..18: mol_type = other DNA
taataccacaagctcttg

SEQ ID NO: 73125 - DNA, 18 bp, synthetic construct
  source 1..18: mol_type = other DNA
taatacctaccactattg

SEQ ID NO: 73126 - DNA, 18 bp, synthetic construct
  source 1..18: mol_type = other DNA
taatacgacacacatatg

SEQ ID NO: 73127 - DNA, 18 bp, synthetic construct
  source 1..18: mol_type = other DNA
taatacggctctcagttg

SEQ ID NO: 73128 - DNA, 18 bp, synthetic construct
  source 1..18: mol_type = other DNA
taatactaatccctgaag

SEQ ID NO: 73129 - DNA, 18 bp, synthetic construct
  source 1..18: mol_type = other DNA
taatactactcgcgtgag

SEQ ID NO: 73130 - DNA, 18 bp, synthetic construct
  source 1..18: mol_type = other DNA
taatatgactctcatttg

SEQ ID NO: 73131 - DNA, 18 bp, synthetic construct
  source 1..18: mol_type = other DNA
taattagacacacttttg

SEQ ID NO: 73132 - DNA, 18 bp, synthetic construct
  source 1..18: mol_type = other DNA
taattcaactatcaatag

SEQ ID NO: 73133 - DNA, 18 bp, synthetic construct
  source 1..18: mol_type = other DNA
taattcgattggcttttg

SEQ ID NO: 73134 - DNA, 18 bp, synthetic construct
  source 1..18: mol_type = other DNA
taattcgtctatctattg

SEQ ID NO: 73135 - DNA, 18 bp, synthetic construct
  source 1..18: mol_type = other DNA
tacaaggccttactttag

SEQ ID NO: 73136 - DNA, 18 bp, synthetic construct
  source 1..18: mol_type = other DNA
tacaatgagtcacaatag

SEQ ID NO: 73137 - DNA, 18 bp, synthetic construct
  source 1..18: mol_type = other DNA
tataacgactttctattg

SEQ ID NO: 73138 - DNA, 18 bp, synthetic construct
  source 1..18: mol_type = other DNA
tattaagaatcacaaaag

SEQ ID NO: 73139 - DNA, 18 bp, synthetic construct
  source 1..18: mol_type = other DNA
tattacaacacaccaaag

SEQ ID NO: 73140 - DNA, 18 bp, synthetic construct
  source 1..18: mol_type = other DNA
tattacaactctcaaaag

SEQ ID NO: 73141 - DNA, 18 bp, synthetic construct
  source 1..18: mol_type = other DNA
tattacatatcactttgg

SEQ ID NO: 73142 - DNA, 18 bp, synthetic construct
  source 1..18: mol_type = other DNA
tattaccaaacacttaag

SEQ ID NO: 73143 - DNA, 18 bp, synthetic construct
  source 1..18: mol_type = other DNA
tattacgtctctcttaag

SEQ ID NO: 73144 - DNA, 18 bp, synthetic construct
  source 1..18: mol_type = other DNA
tattacgtctttttatag

SEQ ID NO: 73145 - DNA, 18 bp, synthetic construct
  source 1..18: mol_type = other DNA
tattactacacgctctag

SEQ ID NO: 73146 - DNA, 18 bp, synthetic construct
  source 1..18: mol_type = other DNA
tattactactcgcaattg

SEQ ID NO: 73147 - DNA, 18 bp, synthetic construct
  source 1..18: mol_type = other DNA
tattactactttctaaag

SEQ ID NO: 73148 - DNA, 18 bp, synthetic construct
  source 1..18: mol_type = other DNA
tattactatttattatag

SEQ ID NO: 73149 - DNA, 18 bp, synthetic construct
  source 1..18: mol_type = other DNA
tattatccctcactaaag

SEQ ID NO: 73150 - DNA, 18 bp, synthetic construct
  source 1..18: mol_type = other DNA
tatttcgacacaccttag

SEQ ID NO: 73151 - DNA, 18 bp, synthetic construct
  source 1..18: mol_type = other DNA
tatttctgctcacctaag

SEQ ID NO: 73152 - DNA, 18 bp, synthetic construct
  source 1..18: mol_type = other DNA
tcatacgaatctttttgg

SEQ ID NO: 73153 - DNA, 18 bp, synthetic construct
  source 1..18: mol_type = other DNA
tcattcgactgtctttag

SEQ ID NO: 73154 - DNA, 18 bp, synthetic construct
  source 1..18: mol_type = other DNA
tcgtacgacgcacattag

SEQ ID NO: 73155 - DNA, 18 bp, synthetic construct
  source 1..18: mol_type = other DNA
tcttacgactcacttatg

SEQ ID NO: 73156 - DNA, 18 bp, synthetic construct
  source 1..18: mol_type = other DNA
tgattcgtctcacaaaag

SEQ ID NO: 73157 - DNA, 18 bp, synthetic construct
  source 1..18: mol_type = other DNA
ttaaaattctcgctaatg

SEQ ID NO: 73158 - DNA, 18 bp, synthetic construct
  source 1..18: mol_type = other DNA
ttaagcgaatctctattg

SEQ ID NO: 73159 - DNA, 18 bp, synthetic construct
  source 1..18: mol_type = other DNA
ttataagacttgctttag

SEQ ID NO: 73160 - DNA, 18 bp, synthetic construct
  source 1..18: mol_type = other DNA
ttatacaacacactttcg

SEQ ID NO: 73161 - DNA, 18 bp, synthetic construct
  source 1..18: mol_type = other DNA
ttatacgactctacattg

SEQ ID NO: 73162 - DNA, 18 bp, synthetic construct
  source 1..18: mol_type = other DNA
ttatactacactctattg

SEQ ID NO: 73163 - DNA, 18 bp, synthetic construct
  source 1..18: mol_type = other DNA
ttatccgactcacttatg

SEQ ID NO: 73164 - DNA, 18 bp, synthetic construct
  source 1..18: mol_type = other DNA
ttatccggcacactaaag

SEQ ID NO: 73165 - DNA, 18 bp, synthetic construct
  source 1..18: mol_type = other DNA
ttattcaactcacaaaag

SEQ ID NO: 73166 - DNA, 18 bp, synthetic construct
  source 1..18: mol_type = other DNA
ttgtacctttcactatag

SEQ ID NO: 73167 - DNA, 18 bp, synthetic construct
  source 1..18: mol_type = other DNA
tttaacgattcacaatag

SEQ ID NO: 73168 - DNA, 18 bp, synthetic construct
  source 1..18: mol_type = other DNA
ttttacgtctcacataag

SEQ ID NO: 73169 - DNA, 18 bp, synthetic construct
  source 1..18: mol_type = other DNA
atatacgtctcacttttg

SEQ ID NO: 73170 - DNA, 18 bp, synthetic construct
  source 1..18: mol_type = other DNA
ttatacgtctctcaattg

SEQ ID NO: 73171 - DNA, 18 bp, synthetic construct
  source 1..18: mol_type = other DNA
aatttcgactcacaattg

SEQ ID NO: 73172 - DNA, 18 bp, synthetic construct
  source 1..18: mol_type = other DNA
aaatacgacttacaaatg

SEQ ID NO: 73173 - DNA, 18 bp, synthetic construct
  source 1..18: mol_type = other DNA
aaatacgtctctttttag

SEQ ID NO: 73174 - DNA, 18 bp, synthetic construct
  source 1..18: mol_type = other DNA
aaatacgtttcacaaaag

SEQ ID NO: 73175 - DNA, 18 bp, synthetic construct
  source 1..18: mol_type = other DNA
aaatactaatcattttag

SEQ ID NO: 73176 - DNA, 18 bp, synthetic construct
  source 1..18: mol_type = other DNA
aagttcgattctctttag

SEQ ID NO: 73177 - DNA, 18 bp, synthetic construct
  source 1..18: mol_type = other DNA
aatggccaatcactgtag

SEQ ID NO: 73178 - DNA, 18 bp, synthetic construct
  source 1..18: mol_type = other DNA
acatacgtctcaccattg

SEQ ID NO: 73179 - DNA, 18 bp, synthetic construct
  source 1..18: mol_type = other DNA
atatacgccttccaatgg

SEQ ID NO: 73180 - DNA, 18 bp, synthetic construct
  source 1..18: mol_type = other DNA
atatactacactctatag

SEQ ID NO: 73181 - DNA, 18 bp, synthetic construct
  source 1..18: mol_type = other DNA
atattcgacacactaaag

SEQ ID NO: 73182 - DNA, 18 bp, synthetic construct
  source 1..18: mol_type = other DNA
gattactacactctctag

SEQ ID NO: 73183 - DNA, 18 bp, synthetic construct
  source 1..18: mol_type = other DNA
taaaacgactcacagatg

SEQ ID NO: 73184 - DNA, 18 bp, synthetic construct
  source 1..18: mol_type = other DNA
taaaatgtctcgctttag

SEQ ID NO: 73185 - DNA, 18 bp, synthetic construct
  source 1..18: mol_type = other DNA
taaatttactcactacag

SEQ ID NO: 73186 - DNA, 18 bp, synthetic construct
  source 1..18: mol_type = other DNA
taataaggcttacccttg

SEQ ID NO: 73187 - DNA, 18 bp, synthetic construct
  source 1..18: mol_type = other DNA
taatacgattgaaaaagg

SEQ ID NO: 73188 - DNA, 18 bp, synthetic construct
  source 1..18: mol_type = other DNA
taatacgtatcttcatag

SEQ ID NO: 73189 - DNA, 18 bp, synthetic construct
  source 1..18: mol_type = other DNA
taatcacactcaatttag

SEQ ID NO: 73190 - DNA, 18 bp, synthetic construct
  source 1..18: mol_type = other DNA
taatcattatcactatag

SEQ ID NO: 73191 - DNA, 18 bp, synthetic construct
  source 1..18: mol_type = other DNA
taatccatctctctattg

SEQ ID NO: 73192 - DNA, 18 bp, synthetic construct
  source 1..18: mol_type = other DNA
taatgcgtctcattggag

SEQ ID NO: 73193 - DNA, 18 bp, synthetic construct
  source 1..18: mol_type = other DNA
taattacactcattttag

SEQ ID NO: 73194 - DNA, 18 bp, synthetic construct
  source 1..18: mol_type = other DNA
taattcaagtctcaatag

SEQ ID NO: 73195 - DNA, 18 bp, synthetic construct
  source 1..18: mol_type = other DNA
taattcgcctctttattg

SEQ ID NO: 73196 - DNA, 18 bp, synthetic construct
  source 1..18: mol_type = other DNA
taattcgtctgtctattg

SEQ ID NO: 73197 - DNA, 18 bp, synthetic construct
  source 1..18: mol_type = other DNA
tagttcgtctgacaatag

SEQ ID NO: 73198 - DNA, 18 bp, synthetic construct
  source 1..18: mol_type = other DNA
tatatcgactcacattag

SEQ ID NO: 73199 - DNA, 18 bp, synthetic construct
  source 1..18: mol_type = other DNA
tatcacgactctttattg

SEQ ID NO: 73200 - DNA, 18 bp, synthetic construct
  source 1..18: mol_type = other DNA
tattacaacttactgtgg

SEQ ID NO: 73201 - DNA, 18 bp, synthetic construct
  source 1..18: mol_type = other DNA
tattacgacccacaaatg

SEQ ID NO: 73202 - DNA, 18 bp, synthetic construct
  source 1..18: mol_type = other DNA
tattacgtcccacttaag

SEQ ID NO: 73203 - DNA, 18 bp, synthetic construct
  source 1..18: mol_type = other DNA
tattactactcatttaag

SEQ ID NO: 73204 - DNA, 18 bp, synthetic construct
  source 1..18: mol_type = other DNA
tatttcgatctactatag

SEQ ID NO: 73205 - DNA, 18 bp, synthetic construct
  source 1..18: mol_type = other DNA
tattttttctcactatag

SEQ ID NO: 73206 - DNA, 18 bp, synthetic construct
  source 1..18: mol_type = other DNA
tcgtacgacaagatatag

SEQ ID NO: 73207 - DNA, 18 bp, synthetic construct
  source 1..18: mol_type = other DNA
tgcttcgctttacaatag

SEQ ID NO: 73208 - DNA, 18 bp, synthetic construct
  source 1..18: mol_type = other DNA
ttaaaagtctcacaatag

SEQ ID NO: 73209 - DNA, 18 bp, synthetic construct
  source 1..18: mol_type = other DNA
ttaaatgtctaactatcg

SEQ ID NO: 73210 - DNA, 18 bp, synthetic construct
  source 1..18: mol_type = other DNA
ttatacgtaacactaaag

SEQ ID NO: 73211 - DNA, 18 bp, synthetic construct
  source 1..18: mol_type = other DNA
ttatacgtcactctagag

SEQ ID NO: 73212 - DNA, 18 bp, synthetic construct
  source 1..18: mol_type = other DNA
ttatacttctctcaatag

SEQ ID NO: 73213 - DNA, 18 bp, synthetic construct
  source 1..18: mol_type = other DNA
ttattctacatacataag

SEQ ID NO: 73214 - DNA, 18 bp, synthetic construct
  source 1..18: mol_type = other DNA
ttctactactaattatag

SEQ ID NO: 73215 - DNA, 18 bp, synthetic construct
  source 1..18: mol_type = other DNA
ttgtatgcctcactttag

SEQ ID NO: 73216 - DNA, 18 bp, synthetic construct
  source 1..18: mol_type = other DNA
ttttattactcactaaag

SEQ ID NO: 73217 - DNA, 18 bp, synthetic construct
  source 1..18: mol_type = other DNA
ttttccgattcactatgg

SEQ ID NO: 73218 - DNA, 18 bp, synthetic construct
  source 1..18: mol_type = other DNA
aaaaacgtctctctattg

SEQ ID NO: 73219 - DNA, 18 bp, synthetic construct
  source 1..18: mol_type = other DNA
aaatgcgactgacaatgg

SEQ ID NO: 73220 - DNA, 18 bp, synthetic construct
  source 1..18: mol_type = other DNA
aattacgattcacaaaag

SEQ ID NO: 73221 - DNA, 18 bp, synthetic construct
  source 1..18: mol_type = other DNA
aattatgactaactaaag

SEQ ID NO: 73222 - DNA, 18 bp, synthetic construct
  source 1..18: mol_type = other DNA
atattcgactcaccattg

SEQ ID NO: 73223 - DNA, 18 bp, synthetic construct
  source 1..18: mol_type = other DNA
taaaacgattctctttcg

SEQ ID NO: 73224 - DNA, 18 bp, synthetic construct
  source 1..18: mol_type = other DNA
taaagcgactcactcatg

SEQ ID NO: 73225 - DNA, 18 bp, synthetic construct
  source 1..18: mol_type = other DNA
taaatggactcactaatg

SEQ ID NO: 73226 - DNA, 18 bp, synthetic construct
  source 1..18: mol_type = other DNA
taatacgaatctttaatg

SEQ ID NO: 73227 - DNA, 18 bp, synthetic construct
  source 1..18: mol_type = other DNA
taatacgatattctttag

SEQ ID NO: 73228 - DNA, 18 bp, synthetic construct
  source 1..18: mol_type = other DNA
taatactacacacataag

SEQ ID NO: 73229 - DNA, 18 bp, synthetic construct
  source 1..18: mol_type = other DNA
taatactgcaggctatag

SEQ ID NO: 73230 - DNA, 18 bp, synthetic construct
  source 1..18: mol_type = other DNA
taatacttctcacatttg

SEQ ID NO: 73231 - DNA, 18 bp, synthetic construct
  source 1..18: mol_type = other DNA
taatatatctctctattg

SEQ ID NO: 73232 - DNA, 18 bp, synthetic construct
  source 1..18: mol_type = other DNA
taatgcggcactccgtag

SEQ ID NO: 73233 - DNA, 18 bp, synthetic construct
  source 1..18: mol_type = other DNA
taattagtctcactttcg

SEQ ID NO: 73234 - DNA, 18 bp, synthetic construct
  source 1..18: mol_type = other DNA
taattcgaataacttttg

SEQ ID NO: 73235 - DNA, 18 bp, synthetic construct
  source 1..18: mol_type = other DNA
taattcgcatcaccattg

SEQ ID NO: 73236 - DNA, 18 bp, synthetic construct
  source 1..18: mol_type = other DNA
tactacgtctgaattaag

SEQ ID NO: 73237 - DNA, 18 bp, synthetic construct
  source 1..18: mol_type = other DNA
tagttctactctgtatag

SEQ ID NO: 73238 - DNA, 18 bp, synthetic construct
  source 1..18: mol_type = other DNA
tatatcgattcactaaag

SEQ ID NO: 73239 - DNA, 18 bp, synthetic construct
  source 1..18: mol_type = other DNA
tatcacaactaacaatag

SEQ ID NO: 73240 - DNA, 18 bp, synthetic construct
  source 1..18: mol_type = other DNA
tattacgtatcacaattg

SEQ ID NO: 73241 - DNA, 18 bp, synthetic construct
  source 1..18: mol_type = other DNA
tattactactcacaaatg

SEQ ID NO: 73242 - DNA, 18 bp, synthetic construct
  source 1..18: mol_type = other DNA
tattacttctcattattg

SEQ ID NO: 73243 - DNA, 18 bp, synthetic construct
  source 1..18: mol_type = other DNA
tattatgtttctctaaag

SEQ ID NO: 73244 - DNA, 18 bp, synthetic construct
  source 1..18: mol_type = other DNA
tattctgcttaactacag

SEQ ID NO: 73245 - DNA, 18 bp, synthetic construct
  source 1..18: mol_type = other DNA
tatttagattcacaatag

SEQ ID NO: 73246 - DNA, 18 bp, synthetic construct
  source 1..18: mol_type = other DNA
tatttcaactcacattag

SEQ ID NO: 73247 - DNA, 18 bp, synthetic construct
  source 1..18: mol_type = other DNA
tatttcgtattactatag

SEQ ID NO: 73248 - DNA, 18 bp, synthetic construct
  source 1..18: mol_type = other DNA
tcatactacttacttttg

SEQ ID NO: 73249 - DNA, 18 bp, synthetic construct
  source 1..18: mol_type = other DNA
tctaatgactcactattg

SEQ ID NO: 73250 - DNA, 18 bp, synthetic construct
  source 1..18: mol_type = other DNA
tctctcgattcattgaag

SEQ ID NO: 73251 - DNA, 18 bp, synthetic construct
  source 1..18: mol_type = other DNA
tgctcccactttcatttg

SEQ ID NO: 73252 - DNA, 18 bp, synthetic construct
  source 1..18: mol_type = other DNA
ttaatcgacacactttag

SEQ ID NO: 73253 - DNA, 18 bp, synthetic construct
  source 1..18: mol_type = other DNA
ttatacaattcaccaaag

SEQ ID NO: 73254 - DNA, 18 bp, synthetic construct
  source 1..18: mol_type = other DNA
ttatacgactctattaag

SEQ ID NO: 73255 - DNA, 18 bp, synthetic construct
  source 1..18: mol_type = other DNA
ttatacgtcactctaaag

SEQ ID NO: 73256 - DNA, 18 bp, synthetic construct
  source 1..18: mol_type = other DNA
ttatacgtctcactcatg

SEQ ID NO: 73257 - DNA, 18 bp, synthetic construct
  source 1..18: mol_type = other DNA
ttatacgtctcacttatg

SEQ ID NO: 73258 - DNA, 18 bp, synthetic construct
  source 1..18: mol_type = other DNA
ttatactaattcctatag

SEQ ID NO: 73259 - DNA, 18 bp, synthetic construct
  source 1..18: mol_type = other DNA
ttattcaacttactaaag

SEQ ID NO: 73260 - DNA, 18 bp, synthetic construct
  source 1..18: mol_type = other DNA
ttattctactcattaaag

SEQ ID NO: 73261 - DNA, 18 bp, synthetic construct
  source 1..18: mol_type = other DNA
ttctactcctcgctaaag

SEQ ID NO: 73262 - DNA, 18 bp, synthetic construct
  source 1..18: mol_type = other DNA
aaaaacgactctctaatg

SEQ ID NO: 73263 - DNA, 18 bp, synthetic construct
  source 1..18: mol_type = other DNA
aagtaggaaacactttag

SEQ ID NO: 73264 - DNA, 18 bp, synthetic construct
  source 1..18: mol_type = other DNA
aattactactctcaatag

SEQ ID NO: 73265 - DNA, 18 bp, synthetic construct
  source 1..18: mol_type = other DNA
aatttcgacacaccttcg

SEQ ID NO: 73266 - DNA, 18 bp, synthetic construct
  source 1..18: mol_type = other DNA
cgttccgtcttactagag

SEQ ID NO: 73267 - DNA, 18 bp, synthetic construct
  source 1..18: mol_type = other DNA
gaaaacgataaactattg

SEQ ID NO: 73268 - DNA, 18 bp, synthetic construct
  source 1..18: mol_type = other DNA
taaaacgatacacaaaag

SEQ ID NO: 73269 - DNA, 18 bp, synthetic construct
  source 1..18: mol_type = other DNA
taaaactactcacaaatg

SEQ ID NO: 73270 - DNA, 18 bp, synthetic construct
  source 1..18: mol_type = other DNA
taaatcgaatcacattag

SEQ ID NO: 73271 - DNA, 18 bp, synthetic construct
  source 1..18: mol_type = other DNA
taataagactttcttaag

SEQ ID NO: 73272 - DNA, 18 bp, synthetic construct
  source 1..18: mol_type = other DNA
taatacatcacacttttg

SEQ ID NO: 73273 - DNA, 18 bp, synthetic construct
  source 1..18: mol_type = other DNA
taatacgcttcaattcag

SEQ ID NO: 73274 - DNA, 18 bp, synthetic construct
  source 1..18: mol_type = other DNA
taatacgtttctcaaaag

SEQ ID NO: 73275 - DNA, 18 bp, synthetic construct
  source 1..18: mol_type = other DNA
taatactactatcgattg

SEQ ID NO: 73276 - DNA, 18 bp, synthetic construct
  source 1..18: mol_type = other DNA
taatactatttacttttg

SEQ ID NO: 73277 - DNA, 18 bp, synthetic construct
  source 1..18: mol_type = other DNA
taatgcgtcttacaattg

SEQ ID NO: 73278 - DNA, 18 bp, synthetic construct
  source 1..18: mol_type = other DNA
taatttgacactctttag

SEQ ID NO: 73279 - DNA, 18 bp, synthetic construct
  source 1..18: mol_type = other DNA
tacaacgttccactttag

SEQ ID NO: 73280 - DNA, 18 bp, synthetic construct
  source 1..18: mol_type = other DNA
tactacaactctcttatg

SEQ ID NO: 73281 - DNA, 18 bp, synthetic construct
  source 1..18: mol_type = other DNA
tataacgtatcactaaag

SEQ ID NO: 73282 - DNA, 18 bp, synthetic construct
  source 1..18: mol_type = other DNA
tataacgtcacacaatag

SEQ ID NO: 73283 - DNA, 18 bp, synthetic construct
  source 1..18: mol_type = other DNA
tatatcaactcataatag

SEQ ID NO: 73284 - DNA, 18 bp, synthetic construct
  source 1..18: mol_type = other DNA
tatatctacacactatag

SEQ ID NO: 73285 - DNA, 18 bp, synthetic construct
  source 1..18: mol_type = other DNA
tattacgtatccctatcg

SEQ ID NO: 73286 - DNA, 18 bp, synthetic construct
  source 1..18: mol_type = other DNA
tatttcatttcactatag

SEQ ID NO: 73287 - DNA, 18 bp, synthetic construct
  source 1..18: mol_type = other DNA
tcttccgacacattatag

SEQ ID NO: 73288 - DNA, 18 bp, synthetic construct
  source 1..18: mol_type = other DNA
tgattcgactcacatcag

SEQ ID NO: 73289 - DNA, 18 bp, synthetic construct
  source 1..18: mol_type = other DNA
tgttacgattcactttcg

SEQ ID NO: 73290 - DNA, 18 bp, synthetic construct
  source 1..18: mol_type = other DNA
ttaaacgacactctattg

SEQ ID NO: 73291 - DNA, 18 bp, synthetic construct
  source 1..18: mol_type = other DNA
ttatacatccctctatag

SEQ ID NO: 73292 - DNA, 18 bp, synthetic construct
  source 1..18: mol_type = other DNA
ttatacgaaacgcgattg

SEQ ID NO: 73293 - DNA, 18 bp, synthetic construct
  source 1..18: mol_type = other DNA
ttatacgattcacttatg

SEQ ID NO: 73294 - DNA, 18 bp, synthetic construct
  source 1..18: mol_type = other DNA
ttattcggctctcaatag

SEQ ID NO: 73295 - DNA, 18 bp, synthetic construct
  source 1..18: mol_type = other DNA
ttatttgactttcaatag

SEQ ID NO: 73296 - DNA, 18 bp, synthetic construct
  source 1..18: mol_type = other DNA
ttgatcgactcacactag

SEQ ID NO: 73297 - DNA, 18 bp, synthetic construct
  source 1..18: mol_type = other DNA
tttaacgacacactaaag

SEQ ID NO: 73298 - DNA, 18 bp, synthetic construct
  source 1..18: mol_type = other DNA
ttttacgacaccctttag

SEQ ID NO: 73299 - DNA, 18 bp, synthetic construct
  source 1..18: mol_type = other DNA
aatttcgacacactattg

SEQ ID NO: 73300 - DNA, 18 bp, synthetic construct
  source 1..18: mol_type = other DNA
acatacgactcacattcg

SEQ ID NO: 73301 - DNA, 18 bp, synthetic construct
  source 1..18: mol_type = other DNA
atatgcaagtcactatag

SEQ ID NO: 73302 - DNA, 18 bp, synthetic construct
  source 1..18: mol_type = other DNA
atttacgtctcactaaag

SEQ ID NO: 73303 - DNA, 18 bp, synthetic construct
  source 1..18: mol_type = other DNA
caaaccaacacaaaatag

SEQ ID NO: 73304 - DNA, 18 bp, synthetic construct
  source 1..18: mol_type = other DNA
taaaaagactcattttgg

SEQ ID NO: 73305 - DNA, 18 bp, synthetic construct
  source 1..18: mol_type = other DNA
taaaacgtctctccttag

SEQ ID NO: 73306 - DNA, 18 bp, synthetic construct
  source 1..18: mol_type = other DNA
taaatcgtctcacttaag

SEQ ID NO: 73307 - DNA, 18 bp, synthetic construct
  source 1..18: mol_type = other DNA
taatacagttcactgttg

SEQ ID NO: 73308 - DNA, 18 bp, synthetic construct
  source 1..18: mol_type = other DNA
taatacgacacacctatg

SEQ ID NO: 73309 - DNA, 18 bp, synthetic construct
  source 1..18: mol_type = other DNA
taatactacaaactgttg

SEQ ID NO: 73310 - DNA, 18 bp, synthetic construct
  source 1..18: mol_type = other DNA
taatactactttatattg

SEQ ID NO: 73311 - DNA, 18 bp, synthetic construct
  source 1..18: mol_type = other DNA
taatgcgcctctctcaag

SEQ ID NO: 73312 - DNA, 18 bp, synthetic construct
  source 1..18: mol_type = other DNA
taattcgagtctatattg

SEQ ID NO: 73313 - DNA, 18 bp, synthetic construct
  source 1..18: mol_type = other DNA
tactaagaatctctttag

SEQ ID NO: 73314 - DNA, 18 bp, synthetic construct
  source 1..18: mol_type = other DNA
tataacgacagtctatag

SEQ ID NO: 73315 - DNA, 18 bp, synthetic construct
  source 1..18: mol_type = other DNA
tattacgattatccattg

SEQ ID NO: 73316 - DNA, 18 bp, synthetic construct
  source 1..18: mol_type = other DNA
tatttctgctcacttcag

SEQ ID NO: 73317 - DNA, 18 bp, synthetic construct
  source 1..18: mol_type = other DNA
tcatacgactcacatagg

SEQ ID NO: 73318 - DNA, 18 bp, synthetic construct
  source 1..18: mol_type = other DNA
tcatacttctcacaattg

SEQ ID NO: 73319 - DNA, 18 bp, synthetic construct
  source 1..18: mol_type = other DNA
tctttctactcactattg

SEQ ID NO: 73320 - DNA, 18 bp, synthetic construct
  source 1..18: mol_type = other DNA
ttaatcgacactctatag

SEQ ID NO: 73321 - DNA, 18 bp, synthetic construct
  source 1..18: mol_type = other DNA
ttatacgattaacaattg

SEQ ID NO: 73322 - DNA, 18 bp, synthetic construct
  source 1..18: mol_type = other DNA
ttatgcgacttactgaag

SEQ ID NO: 73323 - DNA, 18 bp, synthetic construct
  source 1..18: mol_type = other DNA
ttattcatctcactttag

SEQ ID NO: 73324 - DNA, 18 bp, synthetic construct
  source 1..18: mol_type = other DNA
ttattcgtctctctctag

SEQ ID NO: 73325 - DNA, 18 bp, synthetic construct
  source 1..18: mol_type = other DNA
ttattcgtttcactattg

SEQ ID NO: 73326 - DNA, 18 bp, synthetic construct
  source 1..18: mol_type = other DNA
tttaacgactcacattag

SEQ ID NO: 73327 - DNA, 18 bp, synthetic construct
  source 1..18: mol_type = other DNA
aaaatcgtcttactatag

SEQ ID NO: 73328 - DNA, 18 bp, synthetic construct
  source 1..18: mol_type = other DNA
atatacgacacacaattg

SEQ ID NO: 73329 - DNA, 18 bp, synthetic construct
  source 1..18: mol_type = other DNA
atatacgattcacttttg

SEQ ID NO: 73330 - DNA, 18 bp, synthetic construct
  source 1..18: mol_type = other DNA
atatacttctcactaaag

SEQ ID NO: 73331 - DNA, 18 bp, synthetic construct
  source 1..18: mol_type = other DNA
caatgcgtctcactaatg

SEQ ID NO: 73332 - DNA, 18 bp, synthetic construct
  source 1..18: mol_type = other DNA
ctatacgaaacacaatag

SEQ ID NO: 73333 - DNA, 18 bp, synthetic construct
  source 1..18: mol_type = other DNA
taaaatgtctcgttatcg

SEQ ID NO: 73334 - DNA, 18 bp, synthetic construct
  source 1..18: mol_type = other DNA
taatacaactcatttatg

SEQ ID NO: 73335 - DNA, 18 bp, synthetic construct
  source 1..18: mol_type = other DNA
taatactactatatattg

SEQ ID NO: 73336 - DNA, 18 bp, synthetic construct
  source 1..18: mol_type = other DNA
taatacttaacacattag

SEQ ID NO: 73337 - DNA, 18 bp, synthetic construct
  source 1..18: mol_type = other DNA
taatacttctcgataaag

SEQ ID NO: 73338 - DNA, 18 bp, synthetic construct
  source 1..18: mol_type = other DNA
taatgcttctctctattg

SEQ ID NO: 73339 - DNA, 18 bp, synthetic construct
  source 1..18: mol_type = other DNA
taattcatctcactaatg

SEQ ID NO: 73340 - DNA, 18 bp, synthetic construct
  source 1..18: mol_type = other DNA
taattctactctcattag

SEQ ID NO: 73341 - DNA, 18 bp, synthetic construct
  source 1..18: mol_type = other DNA
taattcttttaactatag

SEQ ID NO: 73342 - DNA, 18 bp, synthetic construct
  source 1..18: mol_type = other DNA
tactccgtatccctagag

SEQ ID NO: 73343 - DNA, 18 bp, synthetic construct
  source 1..18: mol_type = other DNA
tatatcttctcactatag

SEQ ID NO: 73344 - DNA, 18 bp, synthetic construct
  source 1..18: mol_type = other DNA
tatcacgtcttactttag

SEQ ID NO: 73345 - DNA, 18 bp, synthetic construct
  source 1..18: mol_type = other DNA
tattacgtcacacaaaag

SEQ ID NO: 73346 - DNA, 18 bp, synthetic construct
  source 1..18: mol_type = other DNA
tcatacaaatctctttag

SEQ ID NO: 73347 - DNA, 18 bp, synthetic construct
  source 1..18: mol_type = other DNA
tgtttatactcactatag

SEQ ID NO: 73348 - DNA, 18 bp, synthetic construct
  source 1..18: mol_type = other DNA
ttatacgaatcaattttg

SEQ ID NO: 73349 - DNA, 18 bp, synthetic construct
  source 1..18: mol_type = other DNA
ttatacgacttacatatg

SEQ ID NO: 73350 - DNA, 18 bp, synthetic construct
  source 1..18: mol_type = other DNA
ttatacgattcggtaatg

SEQ ID NO: 73351 - DNA, 18 bp, synthetic construct
  source 1..18: mol_type = other DNA
ttattcgtctcacattag

SEQ ID NO: 73352 - DNA, 18 bp, synthetic construct
  source 1..18: mol_type = other DNA
ttgaacgactccctttag

SEQ ID NO: 73353 - DNA, 18 bp, synthetic construct
  source 1..18: mol_type = other DNA
ttttacttctcactttag

SEQ ID NO: 73354 - DNA, 18 bp, synthetic construct
  source 1..18: mol_type = other DNA
taatacgtcactcaattg

SEQ ID NO: 73355 - DNA, 18 bp, synthetic construct
  source 1..18: mol_type = other DNA
agaaacgactcacaatcg

SEQ ID NO: 73356 - DNA, 18 bp, synthetic construct
  source 1..18: mol_type = other DNA
atatatatctcactatag

SEQ ID NO: 73357 - DNA, 18 bp, synthetic construct
  source 1..18: mol_type = other DNA
atatccgtcacactatag

SEQ ID NO: 73358 - DNA, 18 bp, synthetic construct
  source 1..18: mol_type = other DNA
taaaaaggctctctaaag

SEQ ID NO: 73359 - DNA, 18 bp, synthetic construct
  source 1..18: mol_type = other DNA
taatacgaatctataatg

SEQ ID NO: 73360 - DNA, 18 bp, synthetic construct
  source 1..18: mol_type = other DNA
tacttcccctctttcttg

SEQ ID NO: 73361 - DNA, 18 bp, synthetic construct
  source 1..18: mol_type = other DNA
tataaagtctctctatag

SEQ ID NO: 73362 - DNA, 18 bp, synthetic construct
  source 1..18: mol_type = other DNA
tattaagtctcaatttag

SEQ ID NO: 73363 - DNA, 18 bp, synthetic construct
  source 1..18: mol_type = other DNA
tatttcgacacacttttg

SEQ ID NO: 73364 - DNA, 18 bp, synthetic construct
  source 1..18: mol_type = other DNA
tcatacgacactctaatg

SEQ ID NO: 73365 - DNA, 18 bp, synthetic construct
  source 1..18: mol_type = other DNA
tgattcaactcacaattg

SEQ ID NO: 73366 - DNA, 18 bp, synthetic construct
  source 1..18: mol_type = other DNA
tgattcgactctcttaag

SEQ ID NO: 73367 - DNA, 18 bp, synthetic construct
  source 1..18: mol_type = other DNA
ttatacgaatttctattg

SEQ ID NO: 73368 - DNA, 18 bp, synthetic construct
  source 1..18: mol_type = other DNA
ttttacgacactttatag

SEQ ID NO: 73369 - DNA, 18 bp, synthetic construct
  source 1..18: mol_type = other DNA
ttttcctactcactattg

SEQ ID NO: 73370 - DNA, 18 bp, synthetic construct
  source 1..18: mol_type = other DNA
aaatgcgaaacactattg

SEQ ID NO: 73371 - DNA, 18 bp, synthetic construct
  source 1..18: mol_type = other DNA
aaatgcgattcacattag

SEQ ID NO: 73372 - DNA, 18 bp, synthetic construct
  source 1..18: mol_type = other DNA
aaattcgtctcacaaaag

SEQ ID NO: 73373 - DNA, 18 bp, synthetic construct
  source 1..18: mol_type = other DNA
aagtacgattctctttag

SEQ ID NO: 73374 - DNA, 18 bp, synthetic construct
  source 1..18: mol_type = other DNA
aataacgactcacattag

SEQ ID NO: 73375 - DNA, 18 bp, synthetic construct
  source 1..18: mol_type = other DNA
aatttcgtctcactattg

SEQ ID NO: 73376 - DNA, 18 bp, synthetic construct
  source 1..18: mol_type = other DNA
atatacgactcacatttg

SEQ ID NO: 73377 - DNA, 18 bp, synthetic construct
  source 1..18: mol_type = other DNA
taaaacaactatctattg

SEQ ID NO: 73378 - DNA, 18 bp, synthetic construct
  source 1..18: mol_type = other DNA
taattcgacactttaaag

SEQ ID NO: 73379 - DNA, 18 bp, synthetic construct
  source 1..18: mol_type = other DNA
taattcgtctcatttaag

SEQ ID NO: 73380 - DNA, 18 bp, synthetic construct
  source 1..18: mol_type = other DNA
taattcgtttcagtattg

SEQ ID NO: 73381 - DNA, 18 bp, synthetic construct
  source 1..18: mol_type = other DNA
tagtacttctcaccattg

SEQ ID NO: 73382 - DNA, 18 bp, synthetic construct
  source 1..18: mol_type = other DNA
tataacgtcacactaaag

SEQ ID NO: 73383 - DNA, 18 bp, synthetic construct
  source 1..18: mol_type = other DNA
tataacgtctcactcaag

SEQ ID NO: 73384 - DNA, 18 bp, synthetic construct
  source 1..18: mol_type = other DNA
tattacgattctttattg

SEQ ID NO: 73385 - DNA, 18 bp, synthetic construct
  source 1..18: mol_type = other DNA
tattataactcacataag

SEQ ID NO: 73386 - DNA, 18 bp, synthetic construct
  source 1..18: mol_type = other DNA
tgatacgtttcaaaaaag

SEQ ID NO: 73387 - DNA, 18 bp, synthetic construct
  source 1..18: mol_type = other DNA
ttaaaccactcacttttg

SEQ ID NO: 73388 - DNA, 18 bp, synthetic construct
  source 1..18: mol_type = other DNA
ttatacttcacactttag

SEQ ID NO: 73389 - DNA, 18 bp, synthetic construct
  source 1..18: mol_type = other DNA
ttatgcaactctgtattg

SEQ ID NO: 73390 - DNA, 18 bp, synthetic construct
  source 1..18: mol_type = other DNA
tttaacgactcacaaaag

SEQ ID NO: 73391 - DNA, 18 bp, synthetic construct
  source 1..18: mol_type = other DNA
aaataccactctctgttg

SEQ ID NO: 73392 - DNA, 18 bp, synthetic construct
  source 1..18: mol_type = other DNA
aattacgattcacattag

SEQ ID NO: 73393 - DNA, 18 bp, synthetic construct
  source 1..18: mol_type = other DNA
aattactactctctacag

SEQ ID NO: 73394 - DNA, 18 bp, synthetic construct
  source 1..18: mol_type = other DNA
acatacgtccaactatag

SEQ ID NO: 73395 - DNA, 18 bp, synthetic construct
  source 1..18: mol_type = other DNA
atatacgactctatttag

SEQ ID NO: 73396 - DNA, 18 bp, synthetic construct
  source 1..18: mol_type = other DNA
atttttgactcactatag

SEQ ID NO: 73397 - DNA, 18 bp, synthetic construct
  source 1..18: mol_type = other DNA
ccttacgaatctctatag

SEQ ID NO: 73398 - DNA, 18 bp, synthetic construct
  source 1..18: mol_type = other DNA
taaaatgtcacattttag

SEQ ID NO: 73399 - DNA, 18 bp, synthetic construct
  source 1..18: mol_type = other DNA
taatacaactcacatatg

SEQ ID NO: 73400 - DNA, 18 bp, synthetic construct
  source 1..18: mol_type = other DNA
taatacgtctctcaaatg

SEQ ID NO: 73401 - DNA, 18 bp, synthetic construct
  source 1..18: mol_type = other DNA
taatccgtcacacttttg

SEQ ID NO: 73402 - DNA, 18 bp, synthetic construct
  source 1..18: mol_type = other DNA
tataacgtttcactattg

SEQ ID NO: 73403 - DNA, 18 bp, synthetic construct
  source 1..18: mol_type = other DNA
tattacttttcaatatag

SEQ ID NO: 73404 - DNA, 18 bp, synthetic construct
  source 1..18: mol_type = other DNA
tatttcgccacacaatag

SEQ ID NO: 73405 - DNA, 18 bp, synthetic construct
  source 1..18: mol_type = other DNA
tatttctactctcaatag

SEQ ID NO: 73406 - DNA, 18 bp, synthetic construct
  source 1..18: mol_type = other DNA
tgattcgtctctctattg

SEQ ID NO: 73407 - DNA, 18 bp, synthetic construct
  source 1..18: mol_type = other DNA
ttaatccactcactattg

SEQ ID NO: 73408 - DNA, 18 bp, synthetic construct
  source 1..18: mol_type = other DNA
ttatacttttcacaatag

SEQ ID NO: 73409 - DNA, 18 bp, synthetic construct
  source 1..18: mol_type = other DNA
tttaactactcactaaag

SEQ ID NO: 73410 - DNA, 18 bp, synthetic construct
  source 1..18: mol_type = other DNA
aaattcatctcactgtag

SEQ ID NO: 73411 - DNA, 18 bp, synthetic construct
  source 1..18: mol_type = other DNA
aattaagtctcactattg

SEQ ID NO: 73412 - DNA, 18 bp, synthetic construct
  source 1..18: mol_type = other DNA
taatactactttctaatg

SEQ ID NO: 73413 - DNA, 18 bp, synthetic construct
  source 1..18: mol_type = other DNA
taatataacattctatag

SEQ ID NO: 73414 - DNA, 18 bp, synthetic construct
  source 1..18: mol_type = other DNA
taattggattcacttttg

SEQ ID NO: 73415 - DNA, 18 bp, synthetic construct
  source 1..18: mol_type = other DNA
tagattgactcacaatag

SEQ ID NO: 73416 - DNA, 18 bp, synthetic construct
  source 1..18: mol_type = other DNA
tatttcatcacactatag

SEQ ID NO: 73417 - DNA, 18 bp, synthetic construct
  source 1..18: mol_type = other DNA
tatttcgacaaactacag

SEQ ID NO: 73418 - DNA, 18 bp, synthetic construct
  source 1..18: mol_type = other DNA
tcatccgtctaactattg

SEQ ID NO: 73419 - DNA, 18 bp, synthetic construct
  source 1..18: mol_type = other DNA
ttaaacgactcacaaatg

SEQ ID NO: 73420 - DNA, 18 bp, synthetic construct
  source 1..18: mol_type = other DNA
aaatccgtcacactttag

SEQ ID NO: 73421 - DNA, 18 bp, synthetic construct
  source 1..18: mol_type = other DNA
atatacgactatcaatag

SEQ ID NO: 73422 - DNA, 18 bp, synthetic construct
  source 1..18: mol_type = other DNA
taatacatcacacaagag

SEQ ID NO: 73423 - DNA, 18 bp, synthetic construct
  source 1..18: mol_type = other DNA
taatatgtctctcttaag

SEQ ID NO: 73424 - DNA, 18 bp, synthetic construct
  source 1..18: mol_type = other DNA
ttatacaactctcattag

SEQ ID NO: 73425 - DNA, 18 bp, synthetic construct
  source 1..18: mol_type = other DNA
taaaacgaacaactattg

SEQ ID NO: 73426 - DNA, 18 bp, synthetic construct
  source 1..18: mol_type = other DNA
taaaactactcatattag

SEQ ID NO: 73427 - DNA, 18 bp, synthetic construct
  source 1..18: mol_type = other DNA
taatacatctcgcaattg

SEQ ID NO: 73428 - DNA, 18 bp, synthetic construct
  source 1..18: mol_type = other DNA
taatacgaatcatttatg

SEQ ID NO: 73429 - DNA, 18 bp, synthetic construct
  source 1..18: mol_type = other DNA
taatacgtttatctattg

SEQ ID NO: 73430 - DNA, 18 bp, synthetic construct
  source 1..18: mol_type = other DNA
tataaagactcacattag

SEQ ID NO: 73431 - DNA, 18 bp, synthetic construct
  source 1..18: mol_type = other DNA
tcatattactgactgtag

SEQ ID NO: 73432 - DNA, 18 bp, synthetic construct
  source 1..18: mol_type = other DNA
ttatacgtttcaacatag

SEQ ID NO: 73433 - DNA, 18 bp, synthetic construct
  source 1..18: mol_type = other DNA
ttatataactcacttttg

SEQ ID NO: 73434 - DNA, 18 bp, synthetic construct
  source 1..18: mol_type = other DNA
aaatacgtcaaaccatag

SEQ ID NO: 73435 - DNA, 18 bp, synthetic construct
  source 1..18: mol_type = other DNA
atattcgactctcaatag

SEQ ID NO: 73436 - DNA, 18 bp, synthetic construct
  source 1..18: mol_type = other DNA
taatacttcactctaaag

SEQ ID NO: 73437 - DNA, 18 bp, synthetic construct
  source 1..18: mol_type = other DNA
ttatacgactcaaatttg

SEQ ID NO: 73438 - DNA, 18 bp, synthetic construct
  source 1..18: mol_type = other DNA
ttatacgattctctcttg

SEQ ID NO: 73439 - DNA, 18 bp, synthetic construct
  source 1..18: mol_type = other DNA
ttatatgtctctctttag

SEQ ID NO: 73440 - DNA, 18 bp, synthetic construct
  source 1..18: mol_type = other DNA
cattacgatcgaatatag

SEQ ID NO: 73441 - DNA, 18 bp, synthetic construct
  source 1..18: mol_type = other DNA
taattatactcacttttg

SEQ ID NO: 73442 - DNA, 18 bp, synthetic construct
  source 1..18: mol_type = other DNA
tataacgaatctcaatag

SEQ ID NO: 73443 - DNA, 18 bp, synthetic construct
  source 1..18: mol_type = other DNA
tatttcgaatcacaattg

SEQ ID NO: 73444 - DNA, 18 bp, synthetic construct
  source 1..18: mol_type = other DNA
ttatacctatcactttag

SEQ ID NO: 73445 - DNA, 18 bp, synthetic construct
  source 1..18: mol_type = other DNA
ttatacgtctctatttag

SEQ ID NO: 73446 - DNA, 18 bp, synthetic construct
  source 1..18: mol_type = other DNA
ttgtacgtctcaatattg

SEQ ID NO: 73447 - DNA, 18 bp, synthetic construct
  source 1..18: mol_type = other DNA
aaaattgtctcactatag

SEQ ID NO: 73448 - DNA, 18 bp, synthetic construct
  source 1..18: mol_type = other DNA
atatactactcgctattg

SEQ ID NO: 73449 - DNA, 18 bp, synthetic construct
  source 1..18: mol_type = other DNA
atttacgtctcaatatag

SEQ ID NO: 73450 - DNA, 18 bp, synthetic construct
  source 1..18: mol_type = other DNA
taattcaacatacaatag

SEQ ID NO: 73451 - DNA, 18 bp, synthetic construct
  source 1..18: mol_type = other DNA
tataacgtctcacaaaag

SEQ ID NO: 73452 - DNA, 18 bp, synthetic construct
  source 1..18: mol_type = other DNA
tataacgtctcacttaag

SEQ ID NO: 73453 - DNA, 18 bp, synthetic construct
  source 1..18: mol_type = other DNA
taatacgacaaacacaag

SEQ ID NO: 73454 - DNA, 18 bp, synthetic construct
  source 1..18: mol_type = other DNA
tattacgtcacaatttag

SEQ ID NO: 73455 - DNA, 18 bp, synthetic construct
  source 1..18: mol_type = other DNA
tatttcgacacacaaaag

SEQ ID NO: 73456 - DNA, 18 bp, synthetic construct
  source 1..18: mol_type = other DNA
taattcgaatcacttatg

SEQ ID NO: 73457 - DNA, 18 bp, synthetic construct
  source 1..18: mol_type = other DNA
tattaagacttacaattg

SEQ ID NO: 73458 - DNA, 18 bp, synthetic construct
  source 1..18: mol_type = other DNA
ttatacgtctctctaatg

SEQ ID NO: 73459 - DNA, 18 bp, synthetic construct
  source 1..18: mol_type = other DNA
aatttcgactcacttttg

SEQ ID NO: 73460 - DNA, 18 bp, synthetic construct
  source 1..18: mol_type = other DNA
ataaacaactctctatag

SEQ ID NO: 73461 - DNA, 18 bp, synthetic construct
  source 1..18: mol_type = other DNA
ttatacgacaaacaattg

SEQ ID NO: 73462 - DNA, 18 bp, synthetic construct
  source 1..18: mol_type = other DNA
ttatgctactcacaattg

SEQ ID NO: 73463 - DNA, 18 bp, synthetic construct
  source 1..18: mol_type = other DNA
atatacgactcacataag

SEQ ID NO: 73464 - DNA, 18 bp, synthetic construct
  source 1..18: mol_type = other DNA
tttaaagactcactaaag

SEQ ID NO: 73465 - DNA, 18 bp, synthetic construct
  source 1..18: mol_type = other DNA
tacaccgacacattatgg

SEQ ID NO: 73466 - DNA, 18 bp, synthetic construct
  source 1..18: mol_type = other DNA
tataacaactcacattag

SEQ ID NO: 73467 - DNA, 18 bp, synthetic construct
  source 1..18: mol_type = other DNA
taataagtcactctaaag

SEQ ID NO: 73468 - DNA, 18 bp, synthetic construct
  source 1..18: mol_type = other DNA
tattacgacacacataag

SEQ ID NO: 73469 - DNA, 18 bp, synthetic construct
  source 1..18: mol_type = other DNA
tattataactcacaaaag

SEQ ID NO: 73470 - DNA, 18 bp, synthetic construct
  source 1..18: mol_type = other DNA
ttttactactctctattg

SEQ ID NO: 73471 - DNA, 18 bp, synthetic construct
  source 1..18: mol_type = other DNA
tatatcgactctctattg

SEQ ID NO: 73472 - DNA, 18 bp, synthetic construct
  source 1..18: mol_type = other DNA
ttatatttctcactttag

SEQ ID NO: 73473 - DNA, 18 bp, synthetic construct
  source 1..18: mol_type = other DNA
ttattctactctcaatag
